US011591401B2

(12) United States Patent
Desjarlais et al.

(10) Patent No.: US 11,591,401 B2
(45) Date of Patent: Feb. 28, 2023

(54) ANTI-CD28 COMPOSITIONS

(71) Applicant: Xencor, Inc., Monrovia, CA (US)

(72) Inventors: John R. Desjarlais, Pasadena, CA (US); Gregory Moore, Azusa, CA (US); Michael Hedvat, Encino, CA (US); Juan Diaz, Anaheim Hills, CA (US); Veronica Gusti Zeng, Duarte, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 17/558,372

(22) Filed: Dec. 21, 2021

(65) Prior Publication Data

US 2022/0119530 A1 Apr. 21, 2022

Related U.S. Application Data

(63) Continuation of application No. 17/407,135, filed on Aug. 19, 2021.

(60) Provisional application No. 63/067,834, filed on Aug. 19, 2020, provisional application No. 63/092,272, filed on Oct. 15, 2020.

(51) Int. Cl.
| | |
|---|---|
| C07K 16/00 | (2006.01) |
| C12P 21/08 | (2006.01) |
| C12P 21/06 | (2006.01) |
| C12P 21/04 | (2006.01) |
| C12N 5/00 | (2006.01) |
| C12N 5/16 | (2006.01) |
| C12N 1/20 | (2006.01) |
| C12N 15/00 | (2006.01) |
| C07K 16/28 | (2006.01) |
| C07K 1/00 | (2006.01) |

(52) U.S. Cl.
CPC ...... *C07K 16/2827* (2013.01); *C07K 16/2818* (2013.01); *C07K 2317/31* (2013.01); *C07K 2317/522* (2013.01); *C07K 2317/524* (2013.01); *C07K 2317/526* (2013.01); *C07K 2317/53* (2013.01); *C07K 2317/56* (2013.01); *C07K 2317/622* (2013.01)

(58) Field of Classification Search
None
See application file for complete search history.

(56) References Cited

U.S. PATENT DOCUMENTS

| | | |
|---|---|---|
| 4,315,929 A | 2/1982 | Freedman et al. |
| 5,585,097 A | 12/1996 | Bolt et al. |
| 5,731,168 A | 3/1998 | Carter et al. |
| 5,736,137 A | 4/1998 | Anderson et al. |
| 5,807,706 A | 9/1998 | Carter et al. |
| 5,821,333 A | 10/1998 | Carter et al. |
| 6,455,677 B1 | 9/2002 | Park et al. |
| 6,881,557 B2 | 4/2005 | Foote |
| 7,112,324 B1 | 9/2006 | Dorken et al. |
| 7,642,228 B2 | 1/2010 | Carter et al. |
| 7,695,936 B2 | 4/2010 | Carter et al. |
| 7,728,114 B2 | 6/2010 | Mach et al. |
| 8,063,187 B2 | 11/2011 | Chu et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 9,822,181 B2 | 11/2017 | Bonvini et al. |
| 9,856,327 B2 | 1/2018 | Bernett et al. |
| 10,227,410 B2 | 3/2019 | Moore et al. |
| 10,428,155 B2 | 10/2019 | Moore et al. |
| 10,526,417 B2 | 1/2020 | Bernett et al. |
| 11,066,483 B2 | 7/2021 | Nezu et al. |
| 11,396,544 B2 | 7/2022 | Murphy et al. |
| 2002/0076406 A1 | 6/2002 | Leung |
| 2002/0103345 A1 | 8/2002 | Zhu |
| 2002/0131968 A1 | 9/2002 | Waldmann et al. |
| 2003/0017979 A1 | 1/2003 | Mack et al. |
| 2003/0223999 A1 | 12/2003 | Lindhofer |
| 2004/0071696 A1 | 4/2004 | Adams et al. |
| 2004/0162411 A1 | 8/2004 | Lanzavecchia |
| 2005/0136050 A1 | 6/2005 | Kufer et al. |
| 2005/0176028 A1 | 8/2005 | Hofmeiser et al. |

(Continued)

FOREIGN PATENT DOCUMENTS

| | | |
|---|---|---|
| EP | 0425235 B1 | 9/1996 |
| EP | 1752471 | 2/2007 |
| EP | 1829895 | 5/2007 |
| EP | 2006381 | 12/2008 |
| EP | 2009101 A1 | 12/2008 |

(Continued)

OTHER PUBLICATIONS

U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.

(Continued)

*Primary Examiner* — Chun W Dahle

(74) *Attorney, Agent, or Firm* — Louis-Vu T. Nguyen; Christopher J. Betti; Morgan, Lewis & Bockius, LLP

(57) ABSTRACT

Provided herein are novel anti-CD28×anti-B7H3 (also referred to as "αCD28×αB7H3") heterodimeric bispecific antibodies and methods of using such antibodies for the treatment of cancers. Subject αCD28×αB7H3 antibodies are capable of agonistically binding to CD28 costimulatory molecules on T cells and targeting to B7H3 on tumor cells. Thus, such antibodies selectively enhance anti-tumor activity at tumor sites while minimizing peripheral toxicity. The subject antibodies provided herein are particularly useful for enhancing anti-tumor activity when used in combination with other anti-cancer therapies.

5 Claims, 111 Drawing Sheets

Specification includes a Sequence Listing.

(56) References Cited

U.S. PATENT DOCUMENTS

| | | |
|---|---|---|
| 2006/0024298 A1 | 2/2006 | Lazar et al. |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0188493 A1 | 8/2006 | Thomas |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0004195 A1 | 1/2009 | Vranic et al. |
| 2009/0117108 A1 | 5/2009 | Wang et al. |
| 2009/0163699 A1 | 6/2009 | Desjarlais |
| 2009/0246204 A1 | 10/2009 | Hunig |
| 2009/0311253 A1 | 12/2009 | Ghayur et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239582 A1 | 9/2010 | Humphreys et al. |
| 2010/0256340 A1 | 10/2010 | Brinkmann et al. |
| 2010/0298542 A1 | 11/2010 | Igawa et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0189178 A1 | 8/2011 | Desjarlais et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2011/0313135 A1 | 12/2011 | Vanhove et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0078236 A1 | 3/2013 | Mary et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0161790 A1 | 6/2014 | Desjarlais et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0119555 A1 | 4/2015 | Jung et al. |
| 2015/0307628 A1 | 10/2015 | Kim et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2016/0355608 A1 | 12/2016 | Bernett et al. |
| 2017/0020963 A1 | 1/2017 | Qu et al. |
| 2017/0320947 A1 | 11/2017 | Moore et al. |
| 2017/0335016 A1 | 11/2017 | Takahashi |
| 2018/0118828 A1 | 5/2018 | Bernett et al. |
| 2018/0118836 A1 | 5/2018 | Bernett et al. |
| 2018/0127501 A1 | 5/2018 | Bernett et al. |
| 2018/0305465 A1 | 10/2018 | Stevens et al. |
| 2019/0106504 A1 | 4/2019 | Wu et al. |
| 2019/0233534 A1 | 8/2019 | Mehlin et al. |
| 2019/0263909 A1 | 8/2019 | Bernett et al. |
| 2019/0270816 A1 | 9/2019 | Bernett et al. |
| 2019/0382495 A1 | 12/2019 | Bernett et al. |
| 2019/0389951 A1 | 12/2019 | Murphy et al. |
| 2019/0389954 A1 | 12/2019 | Bernett et al. |
| 2020/0199233 A1 | 6/2020 | Murphy et al. |
| 2020/0199234 A1 | 6/2020 | Georges et al. |
| 2020/0239576 A1 | 7/2020 | Murphy et al. |
| 2020/0299388 A1 | 9/2020 | Skokos et al. |
| 2021/0102002 A1 | 4/2021 | Bernett et al. |
| 2022/0089766 A1 | 3/2022 | DiLillo et al. |
| 2022/0233690 A1 | 7/2022 | Olson et al. |

FOREIGN PATENT DOCUMENTS

| | | |
|---|---|---|
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| RU | 2014114179 A | 10/2015 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO1997024373 | 7/1997 |
| WO | WO1997044352 A1 | 11/1997 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO0247721 A1 | 6/2002 |
| WO | WO02051871 A2 | 7/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO03048194 A2 | 6/2003 |
| WO | WO2004010957 | 2/2004 |
| WO | WO2004043493 | 5/2004 |

(56) References Cited

FOREIGN PATENT DOCUMENTS

| | | |
|---|---|---|
| WO | WO2004103272 | 12/2004 |
| WO | WO2004106383 | 12/2004 |
| WO | WO2005063816 | 7/2005 |
| WO | WO2005095456 A1 | 10/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2006131013 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007042309 A2 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008048942 | 4/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO 2011097603 A1 | 8/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011154453 A1 | 12/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013018892 | 2/2013 |
| WO | WO2013022855 | 2/2013 |
| WO | WO2013023251 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013059885 A2 | 5/2013 |
| WO | WO2013063702 | 5/2013 |
| WO | WO2013070565 | 5/2013 |
| WO | WO2013096828 | 6/2013 |
| WO | WO2013125667 | 8/2013 |
| WO | WO2013164694 | 11/2013 |
| WO | WO2013173820 A2 | 11/2013 |
| WO | WO2013180201 | 12/2013 |
| WO | WO2014004586 | 1/2014 |
| WO | WO2014012085 | 1/2014 |
| WO | WO2014018572 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015130728 A1 | 9/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016040294 A2 | 3/2016 |
| WO | WO2016071355 A1 | 5/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016182751 | 11/2016 |
| WO | WO2016210223 A1 | 12/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |

(56) References Cited

FOREIGN PATENT DOCUMENTS

| WO | WO2018005706 | 1/2018 |
|---|---|---|
| WO | WO2018017863 | 1/2018 |
| WO | WO2018041838 | 3/2018 |
| WO | WO2019009726 A1 | 1/2019 |
| WO | WO2019050521 | 3/2019 |
| WO | WO2020006509 A1 | 1/2020 |
| WO | WO 2020023553 A1 | 1/2020 |
| WO | WO 2020033702 A1 | 2/2020 |
| WO | WO2020076970 A1 | 4/2020 |
| WO | WO2020103100 A1 | 5/2020 |
| WO | WO2020132066 A1 | 6/2020 |
| WO | WO2021026387 A2 | 2/2021 |
| WO | WO2021155380 A1 | 8/2021 |
| WO | WO2021173307 A1 | 9/2021 |
| WO | WO2021181233 A2 | 9/2021 |
| WO | WO2021259890 A1 | 12/2021 |
| WO | WO2021260064 A1 | 12/2021 |
| WO | WO2022056199 A1 | 3/2022 |
| WO | WO2022061098 A1 | 3/2022 |
| WO | WO2022056197 A1 | 8/2022 |
| WO | WO2022165171 A1 | 8/2022 |

OTHER PUBLICATIONS

"Polythene Glycol and Derivatives for Advanced PEGylation", Catalog 2005-2006, Nektar Therapeutics.

"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.

Abbott Laboratories, Strategies and Current Approaches for Improving Drug-Like-Properties During Biologies Drug Candidate Selection, AAPS Webinar—Nov. 10, 2011.

Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.

Alberola-lla et al., Stimulation Through the TCR/CD3 Complex Up-Regulates the CD2 Srface Expression on Human T Lymphocytes, Feb. 15, 1991.

Alibaud et al., A New Monoclonal Anti-CD3? Antibody Reactive on Paraffin Sections, Journal of Histochemistry & Cytochemistry, 2000, vol. 48, p. 1609.

An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., , Preparation, properties, and applications of carbohydrate conjugates of proteins and lipids, 1981, CRC Crit. Rev. Biochem., pp. 259-306.

Arnett, et al., Crystal structure of a human CD3-$\epsilon$/$\delta$ dimer in complex with a UCHT1 single-chain antibody fragment, PNAS, 2004, vol. 101, No. 46, pp. 16268-16273.

Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.

Atwell, et al., Stable Heterodimers from Remodeling the Domain Interface of a Homodimer using a Phage Display Library, J. Mol. Biol., 1997, vol. 270, pp. 26-35.

Baca et al., Antibody humanization using monovalent phage display, 1997, J. Biol. Chem. 272(16):10678-10684.

Baeuerle, et al., Response to Letter, "Correct TandAb protein," Molecular Immunology, 2007, vol. 44, p. 3084.

Baeuerle, et al., Review—Bispecific T-Cell Engaging Antibodies for Cancer Therapy, Cancer Res, 2009, vol. 69: (12), pp. 4941-4944.

Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

Bargou et al., Tumor Regression in Cancer Patients by Very Low Doses of a T Cell-Engaging Antibody, Science, 2008, vol. 321, pp. 974-977.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

Biochemica, Your apoptosis specialist, 1999, No. 2, pp. 34-37 (Roche Molecular Biochemicals).

Bird et al., Single-chain antigen-binding proteins, 1988, Science 242:423-426.

Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.

Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

Bortoletto, Nicola et al., "Optimizing anti-CD3 affinity for effective T cell targeting against tumor cells.", Eur J Immunol. Nov. 2002;32(11):3102-7.

Boswell et al., Effects of Charge on Antibody Tissue Distribution and Pharmacokinetics, 2010, Bioconjugate Chem, 21(21):2153-2163.

Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.

Brinkmann , et al., presentation slideshow—"Roche Penzberg & Roche Glycart, Schlieren: Centers of Excellence for Recombinant Proteins".

Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.

Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.

Carter et al., Antibody-drug conjugates for cancer therapy, 2008, Cancer J. 14(3):154-169.

Carter et al., Humanization of an anti-p185HER2 antibody for human cancer therapy, 1992, Proc Natl Acad Sci USA 89:4285-9.

Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.

Cemerski, et al., Suppression of mast cell degranulation through a dual-targeting tandem IgE-IgG Fc domain biologic engineered to bind with high affinity to Fc$\gamma$RIIb., Immunol Lett. Mar. 30, 2012;143(1):34-43. doi: 10.1016/j.imlet.2012.01.008. Epub Jan. 25, 2012.

Chames et al., Bispecific antibodies for cancer therapy—The light at the end of the tunnel?, mAbs, 2009, vol. 1, Issue 6, pp. 1-9.

(56) References Cited

OTHER PUBLICATIONS

Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Immunotherapy with Long-Lived Anti-CD123 x Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.
Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z Car T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins By T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.

(56) References Cited

OTHER PUBLICATIONS

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11 (7) , pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$,1978, Biochem. Biophys. Res. Commun. 80(4):849-57.
Francois, et al., Construction of a Bispecific Antibody Reacting with the α- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemisnsiry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$-Segments in the Preferential Reassociation of Immunoglobulin Subunits, Molecular Immunology, 1986, vol. 23, No. 5, pp. 503-510.
HAwkins et al., Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.

He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconjugates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.

(56) References Cited

OTHER PUBLICATIONS

Jones et al., Replacing the complementarity-determining regions in a human antibody with those from a mouse, 1986, Nature 321:522-525.

Jordan et al., Structural understanding of stabilization patterns in engineered bispecific Ig-like antibody molecules, Proteins 2009; 77:832-841, Jun. 19, 2009.

Jung, et al., Design of interchain disulfide bonds in the framework region of the Fv fragment of the monoclonal antibody B3, Proteins, 1994, vol. 19(1), pp. 35-47.

Jung, et al., Target Cell-restricted Triggering of the CD95 (APO-1/Fas) Death Receptor with Bispecific Antibody Fragments, Cancer Research, 2001, vol. 61, pp. 1846-1848.

Jungbluth et al., A monoclonal antibody recognizing human cancers with amplification/overexpression of the human epidermal growth factor receptor, 2003, Proc Natl Acad Sci U S A. 100(2):639-44.

Kabat et al., 1991, Sequences of proteins of immunological interest, Department of Health and Human Services, Bethesda, vol. 1, $5^{th}$ Ed.

Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

Kettleborough et al., Humanization of a mouse monoclonal antibody by CDR-grafting: the importance of framework residues on loop conformation, 1991, Protein Eng. 4(7):773-83.

Keyna, et al., Surrogate Light Chain-Dependent Selection of Ig Heavy Chain V Regions, J. Immunol., 1995, vol. 155, pp. 5536-5542.

Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.

Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.

Kim et al., "Localization of the site of murine IgG1 molecule that is involved in binding the murine intestinal Fc receptor," Eur. J. Immunol., 24:2429-2434, 1994.

Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.

Kipriyanov, et al., Bispecific CD3 x CD19 Diabody for T Cell-Mediated Lysis of Malignant Human B Cells, Int. J. Cancer, 1998. Vol. 77, pp. 763-772.

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klein et al., Progression of metastatic human prostate cancer to androgen independence in immunodeficient SDIC mice, 1997, Nature Medicine 3: 402-408.

Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.

Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992, vol. 148, pp. 1547-1553.

Krah et al., "Single-domain antibodies for biomedical applications.", Immunopharmacol Immunotoxicol. 2016;38(1):21-8. doi: 10.3109/08923973.2015.1102934. Epub Nov. 9, 2015.

Krauss et al., Specificity grafting of human antibody frameworks selected from a phage display library: generation of a highly stable humanized anti-CD22 single-chain Fv fragment, 2003, Protein Engineering 16(10):753-759.

Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No. 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al., Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins o'$_1$ effectively suppress growth and dissemination of liver metastases in a syngeneic model of murine neuroblastoma, 1998, Cancer Res. 58:2928.

(56) References Cited

OTHER PUBLICATIONS

Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging BiTE antibodies specific for EGFR potently eliminate KRAS-and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/VEGF—A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, CurrOpin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al., Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink2011, 135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. 2014 Apr. 21;9(4):e95517. doi: 10.1371/journal, pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al., Phase I trial and tumour localization of the anti-EGFR monoclonal antibody ICR62 in head and neck or lung cancer, 1996, Br J Cancer, 73(2):228-35.

Modjtahedi et al., Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3): 129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

(56) References Cited

OTHER PUBLICATIONS

Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T-δ and Tε-s) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.

PETTIT et al., Dolastatins 24. Synthesis of (-)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproinel, 1996, Synthesis 719-725.
Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,!996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.

(56) References Cited

OTHER PUBLICATIONS

Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fvand Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, p. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp 76-136, 1965, Academic Press.
Senter et al., Proceedings of the American Association for Cancer Research, 2004, vol. 45, Abstract No. 623.
Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998;102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG 1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Feγ receptor structural and functional diversity., Proc Natl Acad Sci U S A. Apr. 17, 2012;109(16):6181-6. doi: 10.1073/pnas.1203954109. Epub Apr. 2, 2012.
Soumyarani et al., Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human lgG1 and lgG2 Antibodies from Any Antibody Pair, J. Mol. Biol., 2012, doi:10.1016/j.jmb.2012.04.020.
Szymkowski et al., Creating the next generation of protein therapeutics through rational drug design, Current opinion in drug discovery & development, Sep. 1, 2005, p. 590, XP055354917, England.
Tabrizi et al., Biodistribution mechanisms of therapeutic monoclonal antibodies in health and disease., Aaps J. Mar. 2010;12(1):33-43. doi: 10.1208/s12248-009-9157-5. Epub Nov. 19, 2009.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.
Tarcsa et al., Chapter 10 Dual-Variable Domain Immunoglobulin (DVD-Ig™) Technology: A Versatile, Novel Format for the Next Generation of Dual-Targeting Biologies, Bispecific Antibodies 2011, pp. 171-185, 2011.

(56) References Cited

OTHER PUBLICATIONS

Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, p. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibodydependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble ap T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.
Wigginton et al., An immunoglobulin E-reactive chimeric human immunoglobulin G1 antiiidiotype inhibits basophil degranulation through cross-linking of FcεRI with FcγRIIb., Clinical & Experimental Allergy, 38: 313-319.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastatin 10 derivative auristatin PHE, 2001, Antimicrob. Agents and Chemother. 45(12):3580-3584.
Wu et al., Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al., Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.

(56) References Cited

OTHER PUBLICATIONS

Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, p. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Interv Aging. 2009;4:197-205. Epub May 14, 2009.
Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.
Zhang et al., The development of bispecific antibodies and their applications in tumor immune escape, Experimental Hematology & Oncology20176:12.
Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.
Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.
Masarova et al., Immune Checkpoint Approaches in AML and MDS: A Next Frontier?, The Journal of Targeted Therapies in Cancer, Mar. 6, 2017 (Mar. 6, 2017), XP002784099.
Scott et al., Antibody therapy of cancer., Nat Rev Cancer. Mar. 22, 2012;12(4):278-87. doi: 10.1038/nrc3236.
Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.
Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.
Fos et al., ICOS ligation recruits the p50alpha PI3K regulatory subunit to the immunological synapse., J Immunol. Aug. 1, 2008;181(3):1969-77.
Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol.2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004;34(5):1282-90.
Madrenas et al., Conversion of CTLA-4 from inhibitor to activator of T cells with a bispecific tandem single-chain Fv ligand., J Immunol. May 16, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09.006.
Carpenter et al., Activation of human B cells by the agonist CD40 antibody CP-870,893 and augmentation with simultaneous toll-like receptor 9 stimulation., J Transl Med. Nov. 11, 2009 ;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.
Shields et al.; "High Resolution Mapping of the Binding Site on Human IgG 1 for FcγRI, FcγRII, FcγRIII, and FcRn and Design of IgG1 Variants with Improved Binding to the FcγR*", The Journal of Biological Chemistry, 2001, 276(2):6591-6604.

(56) References Cited

OTHER PUBLICATIONS

Szymkowski et al.;" Anti-CD38—anti-CD3 bispecific antibody in multiple myeloma", Xencor, pp. 1-15. Mar. 28, 2014.
Human Somatostatin R2/SSTR2 Antibody, MAB4224: R&D Systems, https://www.rndsystems.com/products/human-somatostatin-r2-sstr2-antibody-402038_mab4224#product-details, Rev. Feb. 7, 201.
Julg, B. et al. "Enhanced Anti-HIV Functional Activity Associated with Gag-Specific CD8 T-Cell Responses." Journal of Virology 84.11 (2010): 5540-5549. Web. Jul. 13, 2020.
Tutt et al., Trispecific F(ab')3 derivatives that use cooperative signaling via the TCR/CD3 complex and CD2 to activate and redirect resting cytotoxic T cells., The Journal of Immunology Jul. 1, 1991, 147 (1)60-69.
Armour et al., Recombinant human IgG molecules lacking Fcγ receptor I binding and monocyte triggering activities., Eur. J. Immunol. 1999. 29: 2613-2624.
Bogolyubova et al. , Cancer immunotherapy based on the blockade of immune checkpoints, Oct. 2015, Medical Immunology (Russia) 17(5):395.
Schanzer et al., "A Novel Glycoengineered Bispecific Antibody Format for Targeted Inhibition of Epidermal Growth Factor Receptor (EGFR) and Insulin-like Growth Factor Receptor Type I (IGF-1 R) Demonstrating Unique Molecular Properties", Journal of Biological Chemistry, vol. 289, No. 27, May 19, 2014 (May 19, 2014), pp. 18693-18706.
Volker Baum et al., "Antitumor activities of PSMA x CD3 diabodies by redirected T-cell lysis of prostate cancer cells", Immunotherapy, vol. 5, No. 1, pp. 27-38, Jan. 31, 2013.
Stewart et al., "The role of Fc gamma receptors in the activity of immunomodulatory antibodies for cancer", Journal for Immunotherapy of Cancer, Biomed Central, London, Uk, vol. 2, No. 1, Aug. 19, 2014 (Aug. 19, 2014), p. 29.
Moore et al., A robust heterodimeric Fc platform engineered for efficient development of bispecific antibodies of multiple formats., Methods. Feb. 1, 2019;154:38-50. doi:10.1016/j.ymeth.2018.10.006. Epub Oct. 23, 2018.
Celine Monnet et al.: "Selection of IgG variants with increased FcRn binding using random and directed mutagenesis: impact on effector functions", Frontiers in Immunology, vol. 6, No. 39, Feb. 4, 2015 ( Feb. 4, 2015), pp. 1-14, XP055238838, DOI: 10.3389/fimmu.2015.00039.
Sondermann Peter et al.: "Harnessing Fe receptor biology in the design of therapeutic antibodies", Current Opinion in Immunology, Elsevier, Oxford, GB, vol. 40, Mar. 30, 2016 (Mar. 30, 2016), pp. 78-87, XP029551351, ISSN: 0952-7915, DOI: 10.1016/J.COI.2016.03.005.
Deckert et al., "A Novel Humanized CD38-Targeting Antibody, Demonstrates Potent Antitumor Activity in Models of Multiple Myeloma and Other CD38+ Hematologic Malignancies", Clinical Cancer Research, vol. 20, No. 17, pp. 4574-4583 (Sep. 2014).
De Weers et al., "Daratumumab, a Novel Therapeutic Human CD38 Monoclonal Antibody, Induces Killing of Multiple Myeloma and Other Hematological Tumors", The Journal of Immunology, vol. 186, No. 3, pp. 1840-1848 (Dec. 2010).
Wang et al., Comparison of Biologic Activity of Two Anti-PSA/Anti-CD3 Bispecific Singlechain Antibodies, National Journal of Androloqy, vol. 13(1), pp. 8-12 (2007).
Wu et al., Fab-based bispecific antibody formats with robust biophysical properties and biological activity. mAbs, 7:3, 470-482, Published online: May 1, 2015.
Holliger et al., Engineered antibody fragments and the rise of single domains., Nature Biotechnology, vol. 23, pp. 1126-1136 (2005).
Reusch U et al. Anti-CD3 x anti-epidermal growth factor receptor (EGFR) bispecific antibody redirects T-cell cytolytic activity to EGFRpositive cancers in vitro and in an animal model, Clinical Cancer Research, The American Association for Cancer Research, US, vol. 12, No. 1, Jan. 1, 2006 (Jan. 1, 2006), pp. 183-190.

Roland Kontermann: "Dual targeting strategies with bispecific antibodies", mAbs, vol. 4, No. 2, Mar. 1, 2012 (Mar. 1, 2012), pp. 182-197, XP055566203.
Kontermann Rolande: "Recombinant bispecific antibodies for cancer therapy", Acta Pharmacologica Sinica, vol. 26, No. 1, Jan. 1, 2005 (Jan. 1, 2005), pp. 1-9, XP002426874.
Ahmed et al., Humanized Affinity-matured Monoclonal Antibody 8H9 Has Potent Antitumor Activity and Binds to FG Loop of Tumor Antigen B7-H3*., The Journal of Biological Chemistry vol. 290, No. 50, pp. 30018-30029, Dec. 11, 2015.
Bohlen et al., Cytolysis of Leukemic B-Cells by T-Cells Activated via Two Bispecific Antibodies., Cancer Research 53, 4310-4314, Sep. 15, 1993.
Correnti et al., Simultaneous multiple interaction T-cell engaging (SMITE) bispecific antibodies overcome bispecific T-cell engager (BiTE) resistance via CD28 co-stimulation., Leukemia (2018) 32:1239-1243.
Hodge et al., Induction of Antitumor Immunity by Recombinant Vaccinia Viruses Expressing B7-1 or B7-2 Costimulatory Molecules., Cancer Research 54, 5552-5555, Nov. 1, 1994.
Hui et al., T cell costimulatory receptor CD28 is a primary target for PD-1-mediated inhibition., Science 10.1126/science.aaf1292, Mar. 9, 2017.
Jansen et al., An intra-tumoral niche maintains and differentiates stem-like CD8 T cells., Nature vol. 576, pp. 465-470 (2019).
Kamphorst et al., Rescue of exhausted CD8 T cells by PD-1-targeted therapies is CD28-dependent., Science 10.1126/science.aaf0683, Mar. 9, 2017.
Loo et al., Development of an Fc-Enhanced Anti-B7-H3 Monoclonal Antibody with Potent Antitumor Activity., Clin Cancer Res; 18(14) Jul. 15, 2012.
Mary et al., Antagonist properties of monoclonal antibodies targeting human CD28: role of valency and the heavy-chain constant domain., MAbs. Jan.-Feb. 2013;5(1):47-55. doi: 10.4161/mabs.22697. Epub Dec. 5, 2012.
Poirier et al., Advantages of Papio anubis for preclinical testing of immunotoxicity of candidate therapeutic antagonist antibodies targeting CD28., mAbs, 6:3, 697-706, DOI: 10.4161/mabs.28375.
Poirier et al., First-in-Human Study in Healthy Subjects with FR104, a Pegylated Monoclonal Antibody Fragment Antagonist of CD28., J Immunol. Dec. 15, 2016;197(12):4593-4602. doi: 10.4049/jimmunol.1601538. Epub Nov. 14, 2016.
Seaman et al., Genes that Distinguish Physiological and Pathological Angiogenesis., Cancer Cell. Jun. 2007;11(6):539-54. doi: 10.1016/j.ccr.2007.04.017.
Seamen et al., Eradication of Tumors through Simultaneous Ablation of CD276/B7-H3-Positive Tumor Cells and Tumor Vasculature., Cancer Cell 31, 501-515, Apr. 10, 2017.
Shiao et al., Immunomodulatory Properties of FK734, a Humanized Anti-CD28 Monoclonal Antibody With Agonistic and Antagonistic Activities., Transplantation. Feb. 15, 2007;83(3):304-13. doi: 10.1097/01.tp.0000251426.46312.d5.
Skokos et al., A class of costimulatory CD28-bispecific antibodies that enhance the antitumor activity of CD3-bispecific antibodies., Sci Transl Med. Jan. 8, 2020;12(525):eaaw7888. doi: 10.1126/scitranslmed.aaw7888.
Stebbings et al., After TGN1412: Recent developments in cytokine release assays., J Immunotoxicol. Jan. 2013; 10(1): 75-82.
Waite et al., Tumor-targeted CD28 bispecific antibodies enhance the antitumor efficacy of PD-1 immunotherapy., Sci. Transl. Med. 12, eaba2325 (2020).
U.S. Appl. No. 14/156,432, 2014-0212436, U.S. Pat. No. 9,738,722, filed Jan. 15, 2014, Jul. 31, 2014, issued Aug. 22, 2017, Moore et al.
U.S. Appl. No. 14/155,248, 2014-0322217, U.S. Pat. No. 10,487,155, filed Jan. 14, 2014, Oct. 30, 2014, issued Nov. 26, 2019, Moore et al.
U.S. Appl. No. 14/155,334, 2014-0370013, U.S. Pat. No. 10,738,132, filed Jan. 14, 2014, Dec. 18, 2014, issued Aug. 11, 2020, Moore et al.
U.S. Appl. No. 14/155,344, 2014-0294833, U.S. Pat. No. 9,701,759, Jan. 14, 2014, issued Oct. 2, 2014, issued Jul. 11, 2017, Moore et al.

(56) References Cited

OTHER PUBLICATIONS

U.S. Appl. No. 14/205,248, 2014-0288275, U.S. Pat. No. 9,650,446, filed Mar. 11, 2014, Sep. 25, 2014, issued May 16, 2017, Moore et al.
U.S. Appl. No. 15/589,908, 2018-0142040, U.S. Pat. No. 10,738,133, filed May 8, 2017, May24, 2018, issued Aug. 11, 2020, Moore et al.
U.S. Appl. No. 15/633,629, 2018-0215834, U.S. Pat. No. 10,472,427, filed Jun. 26, 2017, Aug 2., 2018, issued Nov. 12, 2019, Moore et al.
U.S. Appl. No. 16/918,922, 2021-0163627, filed Jul. 1, 2020, Jun. 3, 2021, Moore et al.
U.S. Appl. No. 14/214,418, 2014-0356381, U.S. Pat. No. 10,106,624, filed Mar. 14, 2014, Dec. 4, 2014, issued Oct. 23, 2018, Moore et al.
U.S. Appl. No. 14/214,475, 2014-0294836, U.S. Pat. No. 10,519,242, filed Mar. 14, 2014, Oct. 2, 2014, issued Dec. 31, 2019, Chu et al.
U.S. Appl. No. 14/217,166, 2014-0294759, U.S. Pat. No. 10,544,187, filed Mar. 17, 2014, Oct. 2, 2014, issued Jan. 28, 2020, Chu et al.
U.S. Appl. No. 16/721,356, 2020-0339624, filed Dec. 19, 2019, Oct. 29, 2020, Chu et al.
U.S. Appl. No. 14/200,652, 2014-0302064, U.S. Pat. No. 10,968,276, filed Mar. 7, 2014, Oct. 9, 2014, issued Apr. 6, 2021, Moore et al.
U.S. Appl. No. 14/207,489, 2014-0377270, U.S. Pat. No. 10,131,710, filed Mar. 12, 2014, Dec. 25, 2014, issued Nov. 20, 2018, Moore et al.
U.S. Appl. No. 16/162,172, 2019-0270810, U.S. Pat. No. 11,053,316, filed Oct. 16, 2018, Sep. 5, 2019, issued Jul. 6, 2021, Moore et al.
U.S. Appl. No. 17/339,774, filed Jun. 4, 2021, Moore et al.
U.S. Appl. No. 14/200,821, 2014-0294823, U.S. Pat. No. 9,605,084, filed Mar. 7, 2014, Oct. 2, 2014, issued Mar. 28, 2017, Moore et al.
U.S. Appl. No. 14/216,705, 2014-0363426, U.S. Pat. No. 10,858,417, filed Mar. 17, 2014, Dec. 11, 2014, issued Dec. 8, 2020, Moore et al.
U.S. Appl. No. 15/444,026, 2018-0037668, U.S. Pat. No. 10,287,364, filed Feb. 27, 2017, Feb. 8, 2018, issued May 14, 2019, Moore et al.
U.S. Appl. No. 16/364,093, 2020-0048370, filed Mar. 25, 2019, Feb. 13, 2020, Moore et al.
U.S. Appl. No. 17/087,467, 2021-0171608, filed Nov. 2, 2020, Jun. 10, 2021, Moore et al.
U.S. Appl. No. 17/702,734, filed Mar. 23, 2022, Moore et al.
U.S. Appl. No. 14/673,695, 2015-0307629, U.S. Pat. No. 9,822,186, filed Mar. 30, 2015, Oct. 29, 2015, issued Nov. 21, 2017, Bernett et al.
U.S. Appl. No. 15/786,252, 2018-0094079, U.S. Pat. No. 10,858,451, filed Oct. 17, 2017, Apr. 5, 2018, issued Dec. 8, 2020, Bernett et al.
U.S. Appl. No. 17/086,213, 2021-0309762, filed Oct. 30, 2020, Oct-. 7, 2021, Bernett et al.
U.S. Appl. No. 14/952,714, 2016-0229924, U.S. Pat. No. 10,889,653, filed Nov. 25, 2015, Aug. 11, 2016, issued Jan. 12, 2021, Bernett et al.
U.S. Appl. No. 15/141,350, 2016-0355608, U.S. Pat. No. 10,259,887, filed Apr. 28, 2016, Dec. 8, 2016, issued Apr. 16, 2019, Bernett et al.
U.S. Appl. No. 15/945,679, 2018-0282432, U.S. Pat. No. 10,913,803, filed Apr. 4, 2018, Oct. 4, 2018, issued Feb. 9, 2021, Bernett et al.
U.S. Appl. No. 15/945,681, 2018-0223000, U.S. Pat. No. 11,111,315, filed Apr. 4, 2018, Aug. 9, 2018, issued Sep. 7, 2021, Bernett et al.
U.S. Appl. No. 16/354,058, 2019-0202938, filed Mar. 14, 2019, Jul. 4, 2019, Bernett et al.
U.S. Appl. No. 17/124,371, 2021-0102003, filed Dec. 16, 2020, Apr. 8, 2021, Bernett et al.
U.S. Appl. No. 17/504,452, filed Oct. 18, 2021, Bernett et al.
U.S. Appl. No. 17/542,342, filed Dec. 3, 2021, Bernett et al.
U.S. Appl. No. 14/952,786, 2016-0215063, U.S. Pat. No. 10,526,417, filed Nov. 25, 2015, Jul. 28, 2016, issued Jan. 7, 2020, Bernett et al.
U.S. Appl. No. 16/660,415, filed Oct. 22, 2019, Bernett et al.
U.S. Appl. No. 17/736,475, filed May 4, 2022, Bernett et al.
U.S. Appl. No. 14/757,809, 2016-0355600, U.S. Pat. No. 10,428,155, filed Dec. 22, 2015, Dec. 8, 2016, issued Oct. 1, 2019, Moore et al.
U.S. Appl. No. 16/530,946, 2019-0352416, filed Aug. 2, 2019, Nov. 21, 2019, Moore et al.
U.S. Appl. No. 15/063,441, 2017-0037131, U.S. Pat. No. 10,227,411, filed Mar. 7, 2016, Feb. 9, 2017, issued Mar. 12, 2019, Bernett et al.
U.S. Appl. No. 16/297,255, 2019-0194325, U.S. Pat. No. 11,091,548, filed Mar. 8, 2019, Jun. 27, 2019, issued Aug. 17, 2021, Bernett et al.
U.S. Appl. No. 17/372,324, filed Jul. 9, 2021, Bernett et al.
U.S. Appl. No. 15/372,360, 2017-0320947, U.S. Pat. No. 10,227,410, filed Dec. 7, 2016, Nov. 9, 2017, issued Mar. 12, 2019, Moore et al.
U.S. Appl. No. 16/489,539, 2020-0216559, filed Aug. 28, 2019, Jul. 9, 2020, Moore et al.
U.S. Appl. No. 15/623,314, 2018-0118836, U.S. Pat. No. 10,787,518, filed Jun. 14, 2017, May 3, 2018, issued Sep. 29, 2020, Bernett et al.
U.S. Appl. No. 16/435,373, 2019-0382495, filed Jun. 7, 2019, Dec. 19, 2019, Bernett et al.
U.S. Appl. No. 16/435,375, 2019-0389954, Jun. 7, 2019, Dec. 26, 2019, Bernett et al.
U.S. Appl. No. 15/611,361, 2017-0349660, filed Jun. 1, 2017, Dec. 7, 2017, Saville et al.
U.S. Appl. No. 17/123,852, 2021-0147561, filed Dec. 16, 2020, May 20, 2021, Saville et al.
U.S. Appl. No. 15/611,683, 2017-0349657, filed Jun. 1, 2017, Dec. 7, 2017, Saville et al.
U.S. Appl. No. 16/926,518, 2021-0095027, filed. Jul. 10, 2020, Apr. 1, 2021, Saville et al.
U.S. Appl. No. 15/636,590, 2018-0118827, U.S. Pat. No. 10,316,088, filed Jun. 28, 2017, May 3, 2018, issued Jun. 11, 2019, Moore et al.
U.S. Appl. No. 16/393,900, 2019-0248898, filed Apr. 24, 2019, Aug. 15, 2019, Moore et al.
U.S. Appl. No. 15/185,958, 2017-0081420, U.S. Pat. No. 9,850,320, filed Jun. 17, 2016, Mar. 23, 2017, issued Dec. 26, 2017, Bernett et al.
U.S. Appl. No. 15/186,167, 2017-0081424, U.S. Pat. No. 9,856,327, filed Jun. 17, 2016, Mar. 23, 2017, issued Jan. 2, 2018, Bernett et al.
U.S. Appl. No. 15/691,665, 2018-0127501, U.S. Pat. No. 10,793,632, filed Aug. 30, 2017, May 10, 2018, issued Oct. 6, 2020, Moore et al.
U.S. Appl. No. 16/820,375, 2021-0095030, filed Mar. 16, 2020, Apr. 1, 2021, Moore et al.
Steffen Dickopf et al, "Format and geometries matter: Structure-based design defines the functionality of bispecific antibodies", *Computational and Structural Biotechnology Journal*, vol. 18, May 14, 2020 (May 14, 2020), p. 1221-1227.
Roda-Navarro Pedro et al, "Understanding the Spatial Topology of Artificial Immunological Synapses Assembled in T Cell-Redirecting Strategies: A Major Issue in Cancer Immunotherapy", Frontiers in Cell and Developmental Biology, vol. 7, Jan. 10, 2020 (Jan. 10, 2020).
Suurs Frans V et al, "A review of bispecific antibodies and antibody constructs in oncology and clinical challenges", Apr. 24, 2019 (Apr. 24, 2019), vol. 201, p. 103-119.
Chen Shixue et al, "Immunoglobulin Gamma-Like Therapeutic Bispecific Antibody Formats for Tumor Therapy", US Feb. 11, 2019 (Feb. 11, 2019), vol. 2019, p. 1-13.
Thomas Van Blarcom et al, "Productive common light chain libraries yield diverse panels of high affinity bispecific antibodies", MABS, vol. 10, No. 2, Dec. 14, 2017 (Dec. 14, 2017), p. 256-268.
Hedvat Michael et al, "697?Tumor-targeted CD28 costimulatory bispecific antibodies enhance T cell activation in solid tumors", Journal for Immunotherapy of Cancer, vol. 8, No. Suppl 3, Nov. 1, 2020 (Nov. 1, 2020), page A739-A739.

Figure 1

Human CD28 sequence  SEQ ID NO:757
>sp|P10747|CD28_HUMAN T-cell-specific surface glycoprotein CD28 OS=Homo sapiens OX=9606 GN=CD28 PE=1 SV=1
MLRLLLALNLFPSIQVTGNKILVKQSPMLVAYDNAVNLSCKYSYNLFSREFRASLHKGLDSAVEVCVVYGNYSQQLQ
VYSKTGFNCDGKLGNESVTFYLQNLYVNQTDIYFCKIEVMYPPPYLDNEKSNGTIIHVKGKHLCPSPLFPGPSKPFW
VLVVVGGVLACYSLLVTVAFIIFWVRSKRSRLLHSDYMNMTPRRPGPTRKHYQPYAPPRDFAAYRS

Human CD28, extracellular domain  SEQ ID NO:758
>sp|P10747|19-152
NKILVKQSPMLVAYDNAVNLSCKYSYNLFSREFRASLHKGLDSAVEVCVVYGNYSQQLQVYSKTGFNCDGKLGNESV
TFYLQNLYVNQTDIYFCKIEVMYPPPYLDNEKSNGTIIHVKGKHLCPSPLFPGPSKP

Mouse CD28 sequence  SEQ ID NO:759
>sp|P31041|CD28_MOUSE T-cell-specific surface glycoprotein CD28 OS=Mus musculus OX=10090 GN=Cd28 PE=1 SV=2
MTLRLLFLALNFFSVQVTENKILVKQSPLLVVDSNEVSLSCRYSYNLLAKEFRASLYKGVNSDVEVCVGNGNFTYQP
QFRSNAEFNCDGDFDNETVTFRLWNLHVNHTDIYFCKIEFMYPPPYLDNERSNGTIIHIKEKHLCHTQSSPKLFWAL
VVVAGVLFCYGLLVTVALCVIWTNSRRNRLLQSDYMNMTPRRPGLTRKPYQPYAPARDFAAYRP

Mouse CD28, extracellular domain  SEQ ID NO:760
>sp|P31041|20-150
NKILVKQSPLLVVDSNEVSLSCRYSYNLLAKEFRASLYKGVNSDVEVCVGNGNFTYQPQFRSNAEFNCDGDFDNETV
TFRLWNLHVNHTDIYFCKIEFMYPPPYLDNERSNGTIIHIKEKHLCHTQSSPKL

Cynomolgus CD28 sequence  SEQ ID NO:761
>tr|Q0PDN3|Q0PDN3_MACFA CD28 OS=Macaca fascicularis OX=9541 GN=CD28 PE=2 SV=1
MLRLLLALNLLPSIQVTGNKILVKQSPMLVAYDNAVNLSCKYSYNLFSREFRASLHKGLDSAVEVCVVYGNYSQQLQ
VYSKTGFNCDGKLGNESVTFYLQNLYVNQTDIYFCKIEVMYPPPYLDNEKSNGTIIHVKGKHLCPSPLFPGPSKPFW
ALVVVGGVLACYSLLVTVAFCIFWMRSKRSRLLHSDYMNMTPRRPGPTRKHYQPYAPPRDFAAYRS

Cynomolgus CD28, extracellular domain  SEQ ID NO:762
>tr|Q0PDN3|19-152
NKILVKQSPMLVAYDNAVNLSCKYSYNLFSREFRASLHKGLDSAVEVCVVYGNYSQQLQVYSKTGFNCDGKLGNESV
TFYLQNLYVNQTDIYFCKIEVMYPPPYLDNEKSNGTIIHVKGKHLCPSPLFPGPSKP

Figure 2A

Human B7H3 sequence  SEQ ID NO:763
>sp|Q5ZPR3|CD276_HUMAN CD276 antigen OS=Homo sapiens OX=9606 GN=CD276 PE=1 SV=1
MLRRRGSPGMGVHVGAALGALWFCLTGALEVQVPEDPVVALVGTDATLCCSFSPEPGFSLAQLNLIWQLTDTKQLVH
SFAEGQDQGSAYANRTALFPDLLAQGNASLRLQRVRVADEGSFTCFVSIRDFGSAAVSLQVAAPYSKPSMTLEPNKD
LRPGDTVTITCSSYQGYPEAEVFWQDGQGVPLTGNVTTSQMANEQGLFDVHSILRVVLGANGTYSCLVRNPVLQQDA
HSSVTITPQRSPTGAVEVQVPEDPVVALVGTDATLRCSFSPEPGFSLAQLNLIWQLTDTKQLVHSFTEGRDQGSAYA
NRTALFPDLLAQGNASLRLQRVRVADEGSFTCFVSIRDFGSAAVSLQVAAPYSKPSMTLEPNKDLRPGDTVTITCSS
YRGYPEAEVFWQDGQGVPLTGNVTTSQMANEQGLFDVHSVLRVVLGANGTYSCLVRNPVLQQDAHGSVTITGQPMTF
PPEALWVTVGLSVCLIALLVALAFVCWRKIKQSCEEENAGAEDQDGEGEGSKTALQPLKHSDSKEDDGQEIA

Human B7H3, extracellular domain  SEQ ID NO:764
>sp|Q5ZPR3|29-466
LEVQVPEDPVVALVGTDATsLCCSFSPEPGFSLAQLNLIWQLTDTKQLVHSFAEGQDQGSAYANRTALFPDLLAQGN
ASLRLQRVRVADEGSFTCFVSIRDFGSAAVSLQVAAPYSKPSMTLEPNKDLRPGDTVTITCSSYQGYPEAEVFWQDG
QGVPLTGNVTTSQMANEQGLFDVHSILRVVLGANGTYSCLVRNPVLQQDAHSSVTITPQRSPTGAVEVQVPEDPVVA
LVGTDATLRCSFSPEPGFSLAQLNLIWQLTDTKQLVHSFTEGRDQGSAYANRTALFPDLLAQGNASLRLQRVRVADE
GSFTCFVSIRDFGSAAVSLQVAAPYSKPSMTLEPNKDLRPGDTVTITCSSYRGYPEAEVFWQDGQGVPLTGNVTTSQ
MANEQGLFDVHSVLRVVLGANGTYSCLVRNPVLQQDAHGSVTITGQPMTFPPEA

Human B7H3, V1C1 domain  SEQ ID NO:765
LEVQVPEDPVVALVGTDATLCCSFSPEPGFSLAQLNLIWQLTDTKQLVHSFAEGQDQGSAYANRTALFPDLLAQGNA
SLRLQRVRVADEGSFTCFVSIRDFGSAAVSLQVA

Human B7H3, V2C2 domain  SEQ ID NO:766
PTGAVEVQVPEDPVVALVGTDATLRCSFSPEPGFSLAQLNLIWQLTDTKQLVHSFTEGRDQGSAYANRTALFPDLLA
QGNASLRLQRVRVADEGSFTCFVSIRDFGSAAVSLQVAAPYSKPSMTLEPNKDLRPGDTVTITCSSYRGYPEAEVFW
QDGQGVPLTGNVTTSQMANEQGLFDVHSVLRVVLGANGTYSCLVRNPVLQQDAHGSVTIT

Mouse B7H3 sequence  SEQ ID NO:767
>sp|Q8VE98|CD276_MOUSE CD276 antigen OS=Mus musculus OX=10090 GN=Cd276 PE=1 SV=1
MLRGWGGPSVGVCVRTALGVLCLCLTGAVEVQVSEDPVVALVDTDATLRCSFSPEPGFSLAQLNLIWQLTDTKQLVH
SFTEGRDQGSAYSNRTALFPDLLVQGNASLRLQRVRVTDEGSYTCFVSIQDFDSAAVSLQVAAPYSKPSMTLEPNKD
LRPGNMVTITCSSYQGYPEAEVFWKDGQGVPLTGNVTTSQMANERGLFDVHSVLRVVLGANGTYSCLVRNPVLQQDA
HGSVTITGQPLTFPPEALWVTVGLSVCLVVLLVALAFVCWRKIKQSCEEENAGAEDQDGDGEGSKTALRPLKPSENK
EDDGQEIA

Mouse B7H3, extracellular domain  SEQ ID NO:768
>sp|Q8VE98|29-248
VEVQVSEDPVVALVDTDATLRCSFSPEPGFSLAQLNLIWQLTDTKQLVHSFTEGRDQGSAYSNRTALFPDLLVQGNA
SLRLQRVRVTDEGSYTCFVSIQDFDSAAVSLQVAAPYSKPSMTLEPNKDLRPGNMVTITCSSYQGYPEAEVFWKDGQ
GVPLTGNVTTSQMANERGLFDVHSVLRVVLGANGTYSCLVRNPVLQQDAHGSVTITGQPLTFPPEA

Figure 2B

Cynomolgus CD28 sequence (predicted)  SEQ ID NO:769
>XP_015308533.1 PREDICTED: CD276 antigen isoform X1 [Macaca fascicularis]
MKLSSDHVFPLFRKLQWLPAAFRIQFTPVSPSAGAAFHHGEPSCQLPHSKMLHRRGSPGMGVHVGAALGALWFCLTG
ALEVQVPEDPVVALVGTDATLRCSFSPEPGFSLAQLNLIWQLTDTKQLVHSFTEGRDQGSAYANRTALFLDLLAQGN
ASLRLQRVRVADEGSFTCFVSIRDFGSAAVSLQVAAPYSKPSMTLEPNKDLRPGDTVTITCSSYRGYPEAEVFWQDG
QGAPLTGNVTTSQMANEQGLFDVHSVLRVVLGANGTYSCLVRNPVLQQDAHGSITITPQRSPTGAVEVQVPEDPVVA
LVGTDATLRCSFSPEPGFSLAQLNLIWQLTDTKQLVHSFTEGRDQGSAYANRTALFLDLLAQGNASLRLQRVRVADE
GSFTCFVSIRDFGSAAVSLQVAAPYSKPSMTLEPNKDLRPGDTVTITCSSYRGYPEAEVFWQDGQGAPLTGNVTTSQ
MANEQGLFDVHSVLRVVLGANGTYSCLVRNPVLQQDAHGSVTITGQPMTFPPEALWVTVGLSVCLVALLVALAFVCW
RKIKQSCEEENAGAEDQDGEGEGSKTALQPLKHSDSKEDDGQELA

Cynomolgus CD28, extracellular domain  SEQ ID NO:770
>XP_015308533.1|79-516
LEVQVPEDPVVALVGTDATLRCSFSPEPGFSLAQLNLIWQLTDTKQLVHSFTEGRDQGSAYANRTALFLDLLAQGNA
SLRLQRVRVADEGSFTCFVSIRDFGSAAVSLQVAAPYSKPSMTLEPNKDLRPGDTVTITCSSYRGYPEAEVFWQDGQ
GAPLTGNVTTSQMANEQGLFDVHSVLRVVLGANGTYSCLVRNPVLQQDAHGSITITPQRSPTGAVEVQVPEDPVVAL
VGTDATLRCSFSPEPGFSLAQLNLIWQLTDTKQLVHSFTEGRDQGSAYANRTALFLDLLAQGNASLRLQRVRVADEG
SFTCFVSIRDFGSAAVSLQVAAPYSKPSMTLEPNKDLRPGDTVTITCSSYRGYPEAEVFWQDGQGAPLTGNVTTSQM
ANEQGLFDVHSVLRVVLGANGTYSCLVRNPVLQQDAHGSVTITGQPMTFPPEA

Figure 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 3C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 3D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 3E

| Monomer 1 | Monomer 2 |
|---|---|
| K392D/K409D | E356K/D399K |
| K370D/K392D/K409D | E356K/E357K/D399K |
| K274Q/R355Q/N384S/K392N/V397M/Q419E/K447_ | P217R/P228R/N276K |
| K274Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| K274Q/R355Q/Q419E/K447_ | P217R/P228R/N276K |
| K274Q/R355Q/Q419E/K447_ | N276K |
| I199T/N203D/K274Q/R355Q/N384S/K392N/V397M/Q419E/K447_ | Q196K/I199T/P217R/P228R/N276K |
| I199T/N203D/K274Q/R355Q/N384S/K392N/V397M/Q419E/K447_ | Q196K/I199T/N276K |
| I199T/N203D/K274Q/R355Q/Q419E/K447_ | Q196K/I199T/P217R/P228R/N276K |
| I199T/N203D/K274Q/R355Q/Q419E/K447_ | Q196K/I199T/N276K |

Figure 3F

| Monomer 1 | Monomer 2 |
|---|---|
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 4

| Variant constant region | Substitutions |
|---|---|
| pI-ISO(-) | I199T/N203D/K274Q/R355Q/N384S/K392N/N397M/Q418E/K447_ |
| pI_ISO(-)-Fc only | K274Q/R355Q/N384S/K392N/V397M/Q418E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 5

Ablation Variants
G236R
S239G
S239K
S239Q
S239R
V266D
S267K
S267R
H268K
E269R
T299R
T299K
K322A
A327G
A327L
A327N
A327Q
L328E
L328R
P329A
P329H
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
S267K/P329K

Figure 6

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | SEQ ID NO:771 |
| Whitlow linker | GSTSGSGKPGSGEGSTKG | 18 | +1 | SEQ ID NO:772 |
| 6paxA_1 (+A) | IRPRAIGGSKPRVA | 14 | +4 | SEQ ID NO:773 |
| +B | GKGGSGKGGSGKGGS | 15 | +3 | SEQ ID NO:774 |
| +C | GGKGSGGKGSGGKGS | 15 | +3 | SEQ ID NO:775 |
| +D | GGGKSGGGKSGGGKS | 15 | +3 | SEQ ID NO:776 |
| +E | GKGKSGKGKSGKGKS | 15 | +6 | SEQ ID NO:777 |
| +F | GGGKSGGKGSGKGGS | 15 | +3 | SEQ ID NO:778 |
| +G | GKPGSGKPGSGKPGS | 15 | +3 | SEQ ID NO:779 |
| +H | GKPGSGKPGSGKPGSGKPGS | 20 | +4 | SEQ ID NO:780 |
| +I | GKGKSGKGKSGKGKSGKGKS | 20 | +8 | SEQ ID NO:781 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | SEQ ID NO:782 |
| 3hsc_2 (-A) | STAGDTHLGGEDFD | 14 | -4 | SEQ ID NO:783 |
| -B | GEGGSGEGGSGEGGS | 15 | -3 | SEQ ID NO:784 |
| -C | GGEGSGGEGSGGEGS | 15 | -3 | SEQ ID NO:785 |
| -D | GGGESGGGESGGGES | 15 | -3 | SEQ ID NO:786 |
| -E | GEGESGEGESGEGES | 15 | -6 | SEQ ID NO:787 |
| -F | GGGESGGEGSGEGGS | 15 | -3 | SEQ ID NO:788 |
| -G | GEGESGEGESGEGESGEGES | 20 | -8 | SEQ ID NO:789 |

Additional scFv Linkers

| Sequence | SEQ ID NO: |
|---|---|
| GGGGSGGGGSGGGGS | SEQ ID NO:790 |
| GGGGSGGGGSGGGGSGGGGS | SEQ ID NO:791 |
| GSTSGSGKPGSGEGSTKG | SEQ ID NO:792 |
| PRGASKSGSASQTGSAPGS | SEQ ID NO:793 |
| GTAAAGAGAAGGAAAGAAG | SEQ ID NO:794 |
| GTSGSSGSGSGGSGSGGG | SEQ ID NO:795 |
| GKPGSGKPGSGKPGSGKPGS | SEQ ID NO:796 |

Figure 7

Useful domain linkers

| Name | Sequence | SEQ ID NO: |
|---|---|---|
| (GGGGS)$_1$ or GGGGS | GGGGS | SEQ ID NO:797 |
| (GGGGS)$_2$ | GGGGSGGGGS | SEQ ID NO:798 |
| (GGGGS)$_3$ | GGGGSGGGGSGGGGS | SEQ ID NO:799 |
| (GGGGS)$_4$ | GGGGSGGGGSGGGGSGGGGS | SEQ ID NO:800 |
| (GGGGS)$_5$ | GGGGSGGGGSGGGGSGGGGSGGGGS | SEQ ID NO:801 |
| (GGGGS)$_6$ | GGGGSGGGGSGGGGSGGGGSGGGGSGGGGS | SEQ ID NO:802 |
| (GGGGS)$_7$ | GGGGSGGGGSGGGGSGGGGSGGGGSGGGGSGGGGS | SEQ ID NO:803 |
| (GGGGA)$_1$ or GGGGA | GGGGA | SEQ ID NO:804 |
| (GGGGA)$_2$ | GGGGAGGGGA | SEQ ID NO:805 |
| (GGGGA)$_3$ | GGGGAGGGGAGGGGA | SEQ ID NO:806 |
| (GGGGA)$_4$ | GGGGAGGGGAGGGGAGGGGA | SEQ ID NO:807 |
| (GGGGA)$_5$ | GGGGAGGGGAGGGGAGGGGAGGGGA | SEQ ID NO:808 |
| (GGGGA)$_6$ | GGGGAGGGGAGGGGAGGGGAGGGGAGGGGA | SEQ ID NO:809 |
| (GGGGA)$_7$ | GGGGAGGGGAGGGGAGGGGAGGGGAGGGGAGGGGA | SEQ ID NO:810 |
| 30AA-linker | DPALVHQRPAPPGGGGSGGGGSGGGGSGGG | SEQ ID NO:811 |
| (GKPGS)$_1$ or GKPGS | GKPGS | SEQ ID NO:812 |
| (GKPGS)$_5$ | GKPGSGKPGSGKPGSGKPGSGKPGS | SEQ ID NO:813 |
| (GKPGS)$_6$ | GKPGSGKPGSGKPGSGKPGSGKPGSGKPGS | SEQ ID NO:814 |
| (GGGES)$_1$ or GGGES | GGGES | SEQ ID NO:815 |
| "lower half hinge" | KTHTCPPCP | SEQ ID NO:816 |
| "full hinge C220S variant" | EPKSSDKTHTCPPCP | SEQ ID NO:817 |
| "flex lower half hinge" | GGGGSGGGGSKTHTCPPCP | SEQ ID NO:818 |
| "charged lower half hinge1" | GKPGSGKPGSKTHTCPPCP | SEQ ID NO:819 |
| "charged lower half hinge2" | GKPGSKTHTCPPCP | SEQ ID NO:820 |
| "upper half hinge" | EPKSC | SEQ ID NO:821 |
| "flex upper half hinge" | EPKSCGGGGSGGGGS | SEQ ID NO:822 |
| "charged upper half hinge1" | EPKSCGKPGSGKPGS | SEQ ID NO:1182 |
| "charged upper half hinge2" | EPKSCGKPGS | SEQ ID NO:1183 |

Figure 8

| Monomer 1 (-) | Monomer 2 (+) |
|---|---|
| Heterodimer skew variants L368D/K370S | Heterodimer skew variants S364K/E357Q |
| Isosteric pI variant Q295E/N384D/Q418E/N421D | |
| FcKO | FcKO |
| E233P/L234V/L235A/G236_/S267K | E233P/L234V/L235A/G236_/S267K |
| ±M428L/N434S for FcRn | ±M428L/N434S for FcRn |

Figure 9

| XENP | Heterodimer-skew variant, Chain 1 | Heterodimer-skew variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 10A

Heterodimeric Fc Backbone 1

>Heterodimeric Fc Backbone 1 monomer 1 (-) (SEQ ID NO:823)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK >Heterodimeric Fc Backbone 1 monomer 2 (+) (SEQ ID NO:824)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 2

>Heterodimeric Fc Backbone 2 monomer 1 (-) (SEQ ID NO:825)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK >Heterodimeric Fc Backbone monomer 2 (+) (SEQ ID NO:826)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 3

>Heterodimeric Fc Backbone 3 monomer 1 (-) (SEQ ID NO:827)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCEVSGFYPSDIAVEWESDG
QPENNYKTTPPVLDSDGSFFLYSKLTVDKSRWEQGDVFSCSVMHEALHNHYTQKSLSLSPGK >Heterodimeric Fc Backbone 3 monomer 2 (+) (SEQ ID NO:828)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 4

>Heterodimeric Fc Backbone 4 monomer 1 (-) (SEQ ID NO:829)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTENEVSLTCLVKGFYPSDIAVEWESDG
QPENNYKTTPPVLDSDGSFFLYSKLEVDKSRWEQGDVFSCSVMHEALHNHYTQKSLSLSPGK >Heterodimeric Fc Backbone 4 monomer 2 (+) (SEQ ID NO:830)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSKGSFFLYSKLTVDKSRWQQGNVFSCSVMHEALHNHYTQKSLSLSPGK

Figure 10B

Heterodimeric Fc Backbone 5

\>Heterodimeric Fc Backbone 5 monomer 1 (-) (SEQ ID NO:831)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSRDELTKNQVSLTCDVSGFYPSDIAVEWESDG
QPENNYKTTPPVLDSDGSFFLYSKLTVDKSRWEQGDVFSCSVMHEALHNHYTQKSLSLSPGK \>Heterodimeric Fc Backbone 5 monomer 2 (+) (SEQ ID NO:832)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 6

\>Heterodimeric Fc Backbone 6 monomer 1 (-) (SEQ ID NO:833)
APPVAGPSVFLFPPKPKDTLMISRTPEVTCVVVDVKHEDPEVKFNWYVDGVEVHNAKTKPREEEYASTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK \>Heterodimeric Fc Backbone 6 monomer 2 (+) (SEQ ID NO:834)
APPVAGPSVFLFPPKPKDTLMISRTPEVTCVVVDVKHEDPEVKFNWYVDGVEVHNAKTKPREEQYASTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 7

\>Heterodimeric Fc Backbone 7 monomer 1 (-) (SEQ ID NO:835)
APPVAGPSVFLFPPKPKDTLMISRTPEVTCVVVDVKHEDPEVKFNWYVDGVEVHNAKTKPREEEYSSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK \>Heterodimeric Fc Backbone 7 monomer 2 (+) (SEQ ID NO:836)
APPVAGPSVFLFPPKPKDTLMISRTPEVTCVVVDVKHEDPEVKFNWYVDGVEVHNAKTKPREEQYSSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 8

\>Heterodimeric Fc Backbone 8 monomer 1 (-) (SEQ ID NO:837)
APEFLGGPSVFLFPPKPKDTLMISRTPEVTCVVVDVSQEDPEVQFNWYVDGVEVHNAKTKPREEEFNSTYRVVSVLT
VLHQDWLNGKEYKCKVSNKGLPSSIEKTISKAKGQPREPQVYTLPPSQEEMTKNQVSLTCDVSGFYPSDIAVEWESD
GQPENNYKTTPPVLDSDGSFFLYSRLTVDKSRWEEGDVFSCSVMHEALHNHYTQKSLSLSLGK \>Heterodimeric Fc Backbone 8 monomer 2 (+) (SEQ ID NO:838)
APEFLGGPSVFLFPPKPKDTLMISRTPEVTCVVVDVSQEDPEVQFNWYVDGVEVHNAKTKPREEQFNSTYRVVSVLT
VLHQDWLNGKEYKCKVSNKGLPSSIEKTISKAKGQPREPQVYTLPPSQEQMTKNQVKLTCLVKGFYPSDIAVEWESN
GQPENNYKTTPPVLDSDGSFFLYSRLTVDKSRWQEGNVFSCSVMHEALHNHYTQKSLSLSLGK

Figure 10C

Heterodimeric Fc Backbone 9

>Heterodimeric Fc Backbone 9 monomer 1 (-) (SEQ ID NO:839)
APPVAGPSVFLFPPKPKDTLMISRTPEVTCVVVDVSHEDPEVQFNWYVDGVEVHNAKTKPREEEFNSTFRVVSVLTV
VHQDWLNGKEYKCKVSNKGLPAPIEKTISKTKGQPREPQVYTLPPSREEMTKNQVSLTCDVSGFYPSDIAVEWESDG
QPENNYKTTPPMLDSDGSFFLYSKLTVDKSRWEQGDVFSCSVMHEALHNHYTQKSLSLSPGK

>Heterodimeric Fc Backbone 9 monomer 2 (+) (SEQ ID NO:840)
APPVAGPSVFLFPPKPKDTLMISRTPEVTCVVVDVSHEDPEVQFNWYVDGVEVHNAKTKPREEQFNSTFRVVSVLTV
VHQDWLNGKEYKCKVSNKGLPAPIEKTISKTKGQPREPQVYTLPPSREQMTKNQVKLTCLVKGFYPSDIAVEWESNG
QPENNYKTTPPMLDSDGSFFLYSKLTVDKSRWQQGNVFSCSVMHEALHNHYTQKSLSLSPGK

Heterodimeric Fc Backbone 10

>Heterodimeric Fc Backbone 10 monomer 1 (-) (SEQ ID NO:841)
APPVAGPSVFLFPPKPKDTLMISRTPEVTCVVVDVKHEDPEVQFNWYVDGVEVHNAKTKPREEEFNSTFRVVSVLTV
VHQDWLNGKEYKCKVSNKGLPAPIEKTISKTKGQPREPQVYTLPPSREEMTKNQVSLTCDVSGFYPSDIAVEWESDG
QPENNYKTTPPMLDSDGSFFLYSKLTVDKSRWEQGDVFSCSVMHEALHNHYTQKSLSLSPGK

>Heterodimeric Fc Backbone 10 monomer 2 (+) (SEQ ID NO:842)
APPVAGPSVFLFPPKPKDTLMISRTPEVTCVVVDVKHEDPEVQFNWYVDGVEVHNAKTKPREEQFNSTFRVVSVLTV
VHQDWLNGKEYKCKVSNKGLPAPIEKTISKTKGQPREPQVYTLPPSREQMTKNQVKLTCLVKGFYPSDIAVEWESNG
QPENNYKTTPPMLDSDGSFFLYSKLTVDKSRWQQGNVFSCSVMHEALHNHYTQKSLSLSPGK

Heterodimeric Fc Backbone 11

>Heterodimeric Fc Backbone 11 monomer 1 (-) (SEQ ID NO:843)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

>Heterodimeric Fc Backbone 11 monomer 2 (+) (SEQ ID NO:844)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVLHEALHSHYTQKSLSLSPGK

Heterodimeric Fc Backbone 12

>Heterodimeric Fc Backbone 12 monomer 1 (-) (SEQ ID NO:845)
APPVAGPSVFLFPPKPKDTLMISRTPEVTCVVVDVKHEDPEVKFKWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

>Heterodimeric Fc Backbone 12 monomer 2 (+) (SEQ ID NO:846)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Figure 11

2 + 1 mAb-scFv Heterodimeric Fc Backbone

>2 + 1 mAb-scFv Heterodimeric Fc Backbone monomer 1 (-) (SEQ ID NO:847)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPK >2 + 1 mAb-scFv Heterodimeric Fc Backbone monomer 2 (+) (SEQ ID NO:848)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSP

Figure 12

IgG1 CH1(+) + hinge (SEQ ID NO:849)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCP

IgG1 CH1(-) + hinge (SEQ ID NO:850)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCP

IgG2 CH1(+) + hinge (SEQ ID NO:851)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCP

IgG2 CH1(-) + hinge (SEQ ID NO:852)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCP

IgG4 CH1(+) + hinge (SEQ ID NO:853)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRVESKYGPPCPSCP

IgG4 CH1(-) + hinge (SEQ ID NO:854)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPSCP

Figure 13

IgG1 CH1(+) + half hinge (SEQ ID NO:855)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSC

IgG1 CH1(-) + half hinge (SEQ ID NO:856)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSC

Figure 14

IgG1 CH1(+) (SEQ ID NO:857)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKV

IgG1 CH1(-) (SEQ ID NO:858)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKV

IgG2 CH1(+) (SEQ ID NO:859)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTV

IgG2 CH1(-) (SEQ ID NO:860)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTV

IgG4 CH1(+) (SEQ ID NO:861)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRV

IgG4 CH1(-) (SEQ ID NO:862)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRV

Figure 15

IgG1 hinge (SEQ ID NO:863)
EPKSCDKTHTCPPCP

IgG2 hinge (SEQ ID NO:864)
ERKCCVECPPCP

IgG4 hinge (SEQ ID NO:865)
ESKYGPPCPSCP

Figure 16

Light Chain Constant Domain – Kappa (SEQ ID NO: 866)
RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Light Chain Constant Domain – Lambda (SEQ ID NO:867)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

Figure 17

>XENP16432 Nivolumab_H0L0_IgG1_PVA_/S267K

Heavy Chain SEQ ID NO:868
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

Light Chain SEQ ID NO:869
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

| | sequence | SEQ ID NO: |
|---|---|---|
| Variable heavy (vh) domain | EVQLLESGGGLVQPGGSLRLSCAASGFTFSSYAMSWVRQAPGKGLEW VSTISGSGDSTYYADSVKGRFTISRDNSKNTLYLQMNSLRAEDTAVY YCAKSGPGLRQVGFDYWGQGTLVTVSS | SEQ ID NO:870 |
| vhCDR1 | SYAMS | SEQ ID NO:871 |
| vhCDR2 | TISGSGDSTYYADSVKG | SEQ ID NO:872 |
| vhCDR3 | SGPGLRQVGFDY | SEQ ID NO:873 |
| Variable light (vl) domain | DIQMTQSPSSLSASVGDRVTITCRASQSISSYLNWYQQKPGKAPKLL IYAASSLQSGVPSRFSGSGSGTDFTLTISSLQPEDFATYYCQQSYST PFTFGQGTKLEIK | SEQ ID NO:874 |
| vlCDR1 | RASQSISSYLN | SEQ ID NO:875 |
| vlCDR2 | AASSLQS | SEQ ID NO:876 |
| vlCDR3 | QQSYSTPFT | SEQ ID NO:877 |

>XENP28428 1A7[CD28]_H1L1_IgG1_PVA_/S267K

Heavy Chain SEQ ID NO:878
EVQLLESGGGLVQPGGSLRLSCAASGFTFSSYAMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Light Chain SEQ ID NO:879
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 19

|  | sequence | SEQ ID NO: |
|---|---|---|
| Variable heavy (vh) domain 1A7_H1.1 | EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:880 |
| vhCDR1 | SYYMS | SEQ ID NO:881 |
| vhCDR2 | TISGSGDSTYYADSVKG | SEQ ID NO:882 |
| vhCDR3 | SGPGLRQVGFDY | SEQ ID NO:883 |

|  | sequence | SEQ ID NO: |
|---|---|---|
| Variable heavy (vh) domain 1A7_H1.14 | EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSS | SEQ ID NO:884 |
| vhCDR1 | SYYMS | SEQ ID NO:885 |
| vhCDR2 | TISESGDSTYYADSVKG | SEQ ID NO:886 |
| vhCDR3 | SGPGLRQVGFDY | SEQ ID NO:887 |

Figure 20

| | sequence | SEQ ID NO: |
|---|---|---|
| Variable heavy (vh) domain 1A7_L1.71 | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:888 |
| vhCDR1 | RASQSISSYLN | SEQ ID NO:889 |
| vhCDR2 | AASSLQS | SEQ ID NO:890 |
| vhCDR3 | QQVYSTPFT | SEQ ID NO:891 |

Figure 21A

| 1A7[CD28] H1 L1.71 | | |
|---|---|---|
| | Sequence | SEQ ID NO: |
| Variable Heavy (vh) Domain | EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:892 |
| vhCDR1 | SYAMS | SEQ ID NO:893 |
| vhCDR2 | TISGSGDSTYYADSVKG | SEQ ID NO:894 |
| vhCDR3 | SGPGLRQVGFDY | SEQ ID NO:895 |
| Variable Light (vl) Domain | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:896 |
| vlCDR1 | RASQSISSYLN | SEQ ID NO:897 |
| vlCDR2 | AASSLQS | SEQ ID NO:898 |
| vlCDR3 | QQVYSTPFT | SEQ ID NO:899 |

| 1A7[CD28] H1.1 L1.71 | | |
|---|---|---|
| | Sequence | SEQ ID NO: |
| Variable Heavy (vh) Domain | EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:900 |
| vhCDR1 | SYYMS | SEQ ID NO:901 |
| vhCDR2 | TISGSGDSTYYADSVKG | SEQ ID NO:902 |
| vhCDR3 | SGPGLRQVGFDY | SEQ ID NO:903 |
| Variable Light (vl) Domain | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:904 |
| vlCDR1 | RASQSISSYLN | SEQ ID NO:905 |
| vlCDR2 | AASSLQS | SEQ ID NO:906 |
| vlCDR3 | QQVYSTPFT | SEQ ID NO:907 |

Figure 21B

| 1A7[CD28]_H1.14_L1 | | |
|---|---|---|
| | Sequence | SEQ ID NO: |
| Variable Heavy (vh) Domain | EVQLLESGGGLVQPGGSLRLSCAASGFTFSSYYMSWVRQAPGKGLEWVSTISES GDSTYYADSVKGRFTISRDNSKNTLYLQMNSLRAEDTAVYYCAKSGPGLRQVGF DYWGQGTLVTVSS | SEQ ID NO:908 |
| vhCDR1 | SYYMS | SEQ ID NO:909 |
| vhCDR2 | TISESGDSTYYADSVKG | SEQ ID NO:910 |
| vhCDR3 | SGPGLRQVGFDY | SEQ ID NO:911 |
| Variable Light (vl) Domain | DIQMTQSPSSLSASVGDRVTITCRASQSISSYLNWYQQKPGKAPKLLIYAASSL QSGVPSRFSGSGSGTDFTLTISSLQPEDFATYYCQQSYSTPFTFGQGTKLEIK | SEQ ID NO:912 |
| vlCDR1 | RASQSISSYLN | SEQ ID NO:913 |
| vlCDR2 | AASSLQS | SEQ ID NO:914 |
| vlCDR3 | QQSYSTPFT | SEQ ID NO:915 |

| 1A7[CD28]_H1.14_L1.71 | | |
|---|---|---|
| | Sequence | SEQ ID NO: |
| Variable Heavy (vh) Domain | EVQLLESGGGLVQPGGSLRLSCAASGFTFSSYYMSWVRQAPGKGLEWVSTIS ESGDSTYYADSVKGRFTISRDNSKNTLYLQMNSLRAEDTAVYYCAKSGPGLR QVGFDYWGQGTLVTVSS | SEQ ID NO:916 |
| vhCDR1 | SYYMS | SEQ ID NO:917 |
| vhCDR2 | TISESGDSTYYADSVKG | SEQ ID NO:918 |
| vhCDR3 | SGPGLRQVGFDY | SEQ ID NO:919 |
| Variable Light (vl) Domain | DIQMTQSPSSLSASVGDRVTITCRASQSISSYLNWYQQKPGKAPKLLIYAAS SLQSGVPSRFSGSGSGTDFTLTISSLQPEDFATYYCQQVYSTPFTFGQGTKL EIK | SEQ ID NO:920 |
| vlCDR1 | RASQSISSYLN | SEQ ID NO:921 |
| vlCDR2 | AASSLQS | SEQ ID NO:922 |
| vlCDR3 | QQVYSTPFT | SEQ ID NO:923 |

| 1A7 VH/VL Pair | VH SEQ ID NO: | VL SQ ID NO: | scFv Orientation | $K_D$ for human CD28 (nM) |
|---|---|---|---|---|
| L1.71_H1.14 | SEQ ID NO:598 | SEQ ID NO:743 | VLVH | 36.7 (+/- 4.1) |
| H1.14_L1.71 | SEQ ID NO:598 | SEQ ID NO:743 | VHVL | 35(+/- 1.8) |
| H1.1_L1.71 | SEQ ID NO:585 | SEQ ID NO:743 | VHVL | 91.6 (+/-5.7) |
| H1_L1.71 | SEQ ID NO:870 | SEQ ID NO:743 | VHVL | 180(+/-2) |
| L1_H1.14 | SEQ ID NO:598 | SEQ ID NO:874 | VLVH | 286 (+/- 40) |
| H1.14_L1 | SEQ ID NO:598 | SEQ ID NO:874 | VHVL | 229 (+/- 0.4) |

B)

| 1A7 VH/VL Pair | VH SEQ ID NO: | VL SQ ID NO: | | $K_D$ for human CD28 (nM) |
|---|---|---|---|---|
| H1.1_L1 | SEQ ID NO:585 | SEQ ID NO:874 | | 232 (XENP37808) |
| H1.14_L1 | SEQ ID NO:598 | SEQ ID NO:874 | | 62.8 (XENP31398); 200 (XENP37810) |

Figure 23

>XENP27181 HuTN228[CD28]_H1L1_IgG1_PVA_/S267K

Heavy Chain SEQ ID NO:924
QVQLQESGPGLVKPSETLSLTCAVSGFSLTSYGVHWIRQPPGKGLEWLGVIWPGGGTNFNSALMSRLTISEDTSKNQ
VSLKLSSVTAADTAVYYCARDRAYGNYLYAMDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Light Chain SEQ ID NO:925
DIQMTQSPSSLSASVGDRVTITCRASESVEYYVTSLMQWYQQKPGKAPKLLIYAASNVDSGVPSRFSGSGSGTDFTL
TISSLQPEDIATYYCQQSRKVPFTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP27656 empty-HuTN228[CD28]_H1L1_scFv(GKPGS)4-Fc(216)_IgG1_pI(-
)_Isosteric_A_C220S/PVA_/S267K/L368D/K370S-Fc(216)_IgG1_C220S/PVA_/S267K/S364K/E357Q

Chain 1 - empty-Fc(216)_IgG1_pI(-)_Isosteric_A_C220S/PVA_/S267K/L368D/K370S empty-Fc Heavy Chain
SEQ ID NO:926
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

**Chain 2 - HuTN228[CD28]_H1L1_scFv(GKPGS)4-Fc(216)_IgG1_C220S/PVA_/S267K/S364K/E357Q scFv-Fc Heavy
Chain** SEQ ID NO:927
QVQLQESGPGLVKPSETLSLTCAVSGFSLTSYGVHWIRQPPGKGLEWLGVIWPGGGTNFNSALMSRLTISEDTSKNQ
VSLKLSSVTAADTAVYYCARDRAYGNYLYAMDYWGQGTLVTVSS/GKPGSGKPGSGKPGSGKPGS/DIQMTQSPSSL
SASVGDRVTITCRASESVEYYVTSLMQWYQQKPGKAPKLLIYAASNVDSGVPSRFSGSGSGTDFTLTISSLQPEDIA
TYYCQQSRKVPFTFGGGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 24

| Phage anti-CD28 Clone | $K_{Dapp}$ (M) |
|---|---|
| Phage Clone A | 3.31E-08 |
| Phage Clone B | 1.76E-08 |
| Phage Clone C | 8.66E-09 |
| Phage Clone D | 7.40E-08 |
| Phage Clone E | 1.70E-08 |
| Phage Clone F | 1.47E-08 |
| Phage Clone G | 2.84E-08 |
| Phage Clone 1A7 (XENP28428) | 1.45E-08 |

|  | sequence | SEQ ID NO: |
|---|---|---|
| Variable heavy (vh) domain | QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSS | SEQ ID NO:928 |
| vhCDR1 | NYYMH | SEQ ID NO:929 |
| vhCDR2 | IISPSAGTTSYAQKFQG | SEQ ID NO:930 |
| vhCDR3 | GGGSSPRLDY | SEQ ID NO:931 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK | SEQ ID NO:932 |
| vlCDR1 | RASQSISSYLN | SEQ ID NO:933 |
| vlCDR2 | AASSLQS | SEQ ID NO:934 |
| vlCDR3 | QQSYSTPYT | SEQ ID NO:935 |

>XENP32637 2E4A3.189[B7H3] H1L1 IgG1 PVA /S267K

Heavy Chain SEQ ID NO:936
QVQLVQSGAEVKKPGASVKVSCKASGYIFTNYYMHWVRQAPGQGLEWMGIISPSAGTTSYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK Light Chain SEQ ID NO:937
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 27

|  | sequence | SEQ ID NO: |
|---|---|---|
| Variable heavy (vh) domain 2E4A3.189_H1.3 | QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSS | SEQ ID NO:938 |
| vhCDR1 | NHYMH | SEQ ID NO:939 |
| vhCDR2 | IISPSAGSTDYAQKFQG | SEQ ID NO:940 |
| vhCDR3 | GGGSSPRLDY | SEQ ID NO:941 |

|  | sequence | SEQ ID NO: |
|---|---|---|
| Variable heavy (vh) domain 2E4A3.189_H1.22 | QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSS | SEQ ID NO:942 |
| vhCDR1 | NNYMH | SEQ ID NO:943 |
| vhCDR2 | IISPSVGRTAYAQKFQG | SEQ ID NO:944 |
| vhCDR3 | GGGSSPRLDY | SEQ ID NO:945 |

|  | sequence | SEQ ID NO: |
|---|---|---|
| Variable heavy (vh) domain | EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSS | SEQ ID NO:946 |
| vhCDR1 | NYYMA | SEQ ID NO:947 |
| vhCDR2 | SISTGGGSTYYRDSVKG | SEQ ID NO:948 |
| vhCDR3 | DLSAIAATPFAY | SEQ ID NO:949 |
| Variable light (vl) domain | DIQMTQSPSSLSASVGDRVTITCRASQNIYTSLAWYQQKPGKAPKLLIYNAHSLQTGIPSRFSGSGSGADFTLTISSLQPEDFATYFCQQYYSGLTFGSGTKLEIK | SEQ ID NO:950 |
| vlCDR1 | RASQNIYTSLA | SEQ ID NO:951 |
| vlCDR2 | NAHSLQT | SEQ ID NO:952 |
| vlCDR3 | QQYYSGLT | SEQ ID NO:953 |

>XENP33383 6A1[B7H3]_H1L1_IgG1_PVA_/S267K

Heavy Chain  SEQ ID NO:954
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK Light Chain  SEQ ID NO:955
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

| | sequence | SEQ ID NO: |
|---|---|---|
| Variable heavy (vh) domain | QVQLVQSGAEVKKPGASVKVSCKVSGFSLTSYHVSWVRQAPGQGLEW MGAISSGGSSYYNSKFQGRVTMTRDTSTSTVYMELSSLRSEDTAVYF CTGDLGAAISWFAYWGQGTLVTVSS | SEQ ID NO:956 |
| vhCDR1 | GFSLTSYHVS | SEQ ID NO:957 |
| vhCDR2 | AISSGGSSYYNSKFQG | SEQ ID NO:958 |
| vhCDR3 | DLGAAISWFAY | SEQ ID NO:959 |
| Variable light (vl) domain | DIQMTQSPSSLSASVGDRVTITCRTSQSIYKSLAWYQQKPGKAPKLL IYNAHSLQTGIPSRFSGSGSGTDFTLTISSLQPEDFATYFCQQYYSG LTFGSGTKLEIK | SEQ ID NO:960 |
| vlCDR1 | RTSQSIYKSLA | SEQ ID NO:961 |
| vlCDR2 | NAHSLQT | SEQ ID NO:962 |
| vlCDR3 | QQYYSGLT | SEQ ID NO:963 |

|  | sequence | SEQ ID NO: |
|---|---|---|
| Variable heavy (vh) domain | EVQLVESGGGLVKPGGSLRLSCAASGFSFSVGYYMCWVRQAPGKGLE WVSCIYVGSGSSGSTYYASVKGRFTISSDTAKTSVYLQMNSLRAEDT AVYFCARTAGSDWRLDLWGQGTLVTVSS | SEQ ID NO:964 |
| vhCDR1 | VGYYMC | SEQ ID NO:965 |
| vhCDR2 | CIYVGSGSSGSTYYASVKG | SEQ ID NO:966 |
| vhCDR3 | TAGSDWRLDL | SEQ ID NO:967 |
| Variable light (vl) domain | DIVMTQSPSSLSASVGDRVTITCRASQSIANELSWYQQKPGKPPKLL IYRASTLTSGVPSRFKGSGSGTDFTLTISSLQPEDFATYYCQSTYNG RAIGFGGGTKVEIK | SEQ ID NO:968 |
| vlCDR1 | RASQSIANELS | SEQ ID NO:969 |
| vlCDR2 | RASTLTS | SEQ ID NO:970 |
| vlCDR3 | QSTYNGRAIG | SEQ ID NO:971 |

|  | sequence | SEQ ID NO: |
|---|---|---|
| Variable heavy (vh) domain | EVQLLESGGGLVQPGGSLRLSCAVSGFSLSSYGVIWVRQAPGKGLEYVSWVSSGGSTNYASSVKGRFTISRDTSKNTVYLQMNSLRAEDTAVYFCARGATNSGTDIWGPGTLVTVSS | SEQ ID NO:972 |
| vhCDR1 | SYGVI | SEQ ID NO:973 |
| vhCDR2 | WVSSGGSTNYASSVKG | SEQ ID NO:974 |
| vhCDR3 | GATNSGTDI | SEQ ID NO:975 |
| Variable light (vl) domain | DIVMTQSPSSLSASVGDRVTITCRASQSINSWLSWYQQKPGKPPKLLIYGASNLASGVPSRFKGSGSGTDFTLTISSLQPEDFATYYCQNNYGIIAAGATFGGGTKVEIK | SEQ ID NO:976 |
| vlCDR1 | RASQSINSWLS | SEQ ID NO:977 |
| vlCDR2 | GASNLAS | SEQ ID NO:978 |
| vlCDR3 | QNNYGIIAAGAT | SEQ ID NO:979 |

Figure 32

| B7H3 Binding Domain | $K_D$ for human B7H3 (V1C1-V2C2) (nM) | $K_D$ for cynomolgus B7H3 (nM) |
|---|---|---|
| 2E4A3_H1.22_1A7_L1 | 7.6 | 4.3 |
| 2E4A3_H1.3_1A7_L1 | 12 | 7.0 |
| 2E4A3_H1.22_L1 | 6.1 | 5.3 |
| 6A1_H1L1 | 8.1 | 4.2 |
| 4F12_H2_L1.1 | <0.1 | <0.1 |
| 38E2_H2_L1.1 | 0.5 | 1.4 |
| 3C4_H1_L1.1 | 29.7 | 27.2 |

1 + 1 Fab-scFv-Fc

2 + 1 Fab$_2$-scFv-Fc

1 + 1 Common Light Chain

2 + 1 Common Light Chain

2+1 mAb-scFv

1 + 1 Fab-scFv-Fc

2 + 1 Fab$_2$-scFv-Fc

1 + 1 Common Light Chain

2 + 1 Common Light Chain

2+1 mAb-scFv

Figure 35A

>XENP34730 2E4A3.189[B7H3]_H1.22_L1_Fab-1A7[CD28]_H1.14_L1_scFv(GKPGS)4-IgG1_pI(-
)_Isosteric_A_/PVA_/S267K/L368D/K370S-Fc(216)_IgG1_C220S/PVA_/S267K/S364K/E357Q Chain 1 - 2E4A3.189[B7H3]_H1.22_Fab_IgG1_pI(-)_Isosteric_A_/PVA_/S267K/L368D/K370S   SEQ ID NO:980
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK Chain 2 - 1A7[CD28]_H1.14_L1_scFv(GKPGS)4_Fc(216)_IgG1_C220S/PVA_/S267K/S364K/E357Q   SEQ ID NO:981
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK Chain 3 - 2E4A3.189[B7H3]_L1 Light Chain   SEQ ID NO:982
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP34732 6A1[B7H3]_H1L1_Fab-1A7[CD28]_H1.14_L1_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S
Chain 1 - 6A1[B7H3]_H1L1_Fab-IgG1_pI(-)_Isosteric_A_/PVA_/S267K/L368D/K370S/M428L/N434S
 SEQ ID NO:983
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK
Chain 2 - 1A7[CD28]_H1.14_L1_scFv(GKPGS)4-Fc(216)_IgG1_C220S/PVA_/S267K/S364K/E357Q/M428L/N434S
 SEQ ID NO:984
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
LHEALHSHYTQKSLSLSPGK Chain 3 - 6A1[B7H3]_L1   SEQ ID NO:985
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 35B

>XENP35151 4F12[B7H3]_H2_L1.1_Fab-1A7[CD28]_H1.14_L1_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S
Chain 1 - 4F12[B7H3]_H2_L1.1_Fab-IgG1_pI(-)_Isosteric_A_/PVA_/S267K/L368D/K370S/M428L/N434S
 SEQ ID NO:986
EVQLVESGGGLVKPGGSLRLSCAASGFSFSVGYYMCWVRQAPGKGLEWVSCIYVGSGSSGSTYYASVKGRFTISSDT
AKTSVYLQMNSLRAEDTAVYFCARTAGSDWRLDLWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKTHT
CPPCPAPPVAGPSVFLFPPKPKDTLMISRTPEVTCVVVDVKHEDPEVKFNWYVDGVEVHNAKTKPREEEYNSTYRVV
SVLTVLHQDWLNGKEYKCKVSNKALPAPIEKTISKAKGQPREPQVYTLPPSREEMTKNQVSLTCDVSGFYPSDIAVE
WESDGQPENNYKTTPPVLDSDGSFFLYSKLTVDKSRWEQGDVFSCSVLHEALHSHYTQKSLSLSPGK Chain 2 - 1A7[CD28]_H1.14_L1_scFv(GKPGS)4-Fc(216)_IgG1_C220S/PVA_/S267K/S364K/E357Q/M428L/N434S
 SEQ ID NO:987
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLPQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREMTKNQVKLTCLVKGFYPSDIAVEWESNGQPENNYKTTPPVLDSDGSFFLYSKLTVDKSRWQQGNVFSCSV
LHEALHSHYTQKSLSLSPGK Chain 3 - 4F12[B7H3]_L1.1   SEQ ID NO:988
DIVMTQSPSSLSASVGDRVTITCRASQSIANELSWYQQKPGKPPKLLIYRASTLTSGVPSRFKGSGSGTDFTLTISS
LQPEDFATYYCQSTYNGRAIGFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC >XENP35153 38E2[B7H3]_H2_L1.1_Fab-1A7[CD28]_H1.14_L1_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S
Chain 1 - 38E2[B7H3]_H2_L1.1_Fab-IgG1_pI(-)_Isosteric_A_/PVA_/S267K/L368D/K370S/M428L/N434S
 SEQ ID NO:989
EVQLLESGGGLVQPGGSLRLSCAVSGFSLSSYGVIWVRQAPGKGLEYVSWVSSGGSTNYASSVKGRFTISRDTSKNT
VYLQMNSLRAEDTAVYFCARGATNSGTDIWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK Chain 2 - 1A7[CD28]_H1.14_L1_scFv(GKPGS)4-Fc(216)_IgG1_C220S/PVA_/S267K/S364K/E357Q/M428L/N434S
 SEQ ID NO:990
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLPQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREMTKNQVKLTCLVKGFYPSDIAVEWESNGQPENNYKTTPPVLDSDGSFFLYSKLTVDKSRWQQGNVFSCSV
LHEALHSHYTQKSLSLSPGK Chain 3 - 38E2[B7H3]_L1.1  SEQ ID NO:991
DIVMTQSPSSLSASVGDRVTITCRASQSINSWLSWYQQKPGKPPKLLIYGASNLASGVPSRFKGSGSGTDFTLTISS
LQPEDFATYYCQNNYGIIAAGATFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 36A

>XENP34389 6A1[B7H3]_H1L1_Fab-6A1[B7H3]_H1L1_Fab_(G4S)2_1A7[CD28]_H1.14_L1_scFv(GKPGS)4_(G4S)2-IgG1_pI(-)_Isosteric_A_/PVA_/S267K/L368D/K370S-Fc(222)_IgG1_PVA_/S267K/S364K/E357Q Chain 1 - 6A1[B7H3]_H1_Fab_IgG1_pI(-)_Isosteric_A_/PVA_/S267K/L368D/K370S SEQ ID NO:992
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 – 
6A1[B7H3]_H1_Fab_(G4S)2_1A7[CD28]_H1.14_L1_scFv(GKPGS)4_(G4S)2_Fc(222)_IgG1_PVA_/S267K/S364K/E357Q SEQ ID NO:993
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLLESGGGLVQPGGSLRLSCAASGFTFSSYYMSWVRQAPGKGLEWVSTISESGDSTYYADSVKGRFTIS
RDNSKNTLYLQMNSLRAEDTAVYYCAKSGPGLFQVGFDYWGQGTLVTVSS/GKPGSGKPGSGKPGSGKPGS/DIQMT
QSPSSLSASVGDRVTITCRASQSISSYLNWYQQKPGKAPKLLIYAASSLQSGVPSRFSGSGSGTDFTLTISSLQPED
FATYYCQQSYSTPFTFGQGTKLEIK/GGGGSGGGGSKTHTCPPCP/APPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK Chain 3 - 6A1[B7H3]_L1 Light Chain SEQ ID NO:994
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 36B

>XENP34395 6A1[B7H3] H1L1 Fab-6A1[B7H3] H1L1 Fab (G4S)2 1A7[CD28] H1.14 L1 scFv(GKPGS)4 (G4S)2-
IgG1_pI(-) Isosteric_A_/PVA_/S267K/L368D/K370S/M428L/N434S-
Fc(222)_IgG1_PVA_/S267K/S364K/E357Q/M428L/N434S Chain 1 - 6A1[B7H3]_H1_Fab-IgG1_pI(-)_Isosteric_A_/PVA_/S267K/L368D/K370S/M428L/N434S    SEQ ID
NO:995
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK Chain 2 - 6A1[B7H3]_H1_Fab_(G4S)2_1A7[CD28]_H1.14_L1_scFv(GKPGS)4_(G4S)2-
Fc(222)_IgG1_PVA_/S267K/S364K/E357Q/M428L/N434S    SEQ ID NO:996
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKV/EPKSCGGGGS
GGGGS/EVQLLESGGGLVQPGGSLRLSCAASGFTFSSYYMSWVRQAPGKGLEWVSTISESGDSTYYADSVKGRFTIS
RDNSKNTLYLQMNSLRAEDTAVYYCAKSGPGLRQVGFDYWGQGTLVTVSS/GKPGSGKPGSGKPGSGKPGS/DIQMT
QSPSSLSASVGDRVTITCRASQSISSYLNWYQQKPGKAPKLLIYAASSLQSGVPSRFSGSGSGTDFTLTISSLQPED
FATYYCQQSYSTPFTFGQGTKLEIK/GGGGSGGGGSKTHTCPPCP/APPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVLHEALHSHYTQKSLSLSPGK

Figure 36C

Chain 3 - 6A1[B7H3]_L1  SEQ ID NO:997
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP34728 6A1[B7H3]_H1L1_Fab-1A7[CD28]_H1.14_L1_scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 - 6A1[B7H3]_H1_Fab_IgG1_pI(-)_Isosteric_A_/PVA_/S267K/L368D/K370S  SEQ ID NO:998
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - 1A7[CD28]_H1.14_L1_scFv(GKPGS)4_Fc(216)_IgG1_C220S/PVA_/S267K/S364K/E357Q  SEQ ID NO:999
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSSGKPGSGKPGSGKPGSGKPGSDIQMTQSPSSLSA
SVGDRVTITCRASQSISSYLNWYQQKPGKAPKLLIYAASSLQSGVPSRFSGSGSGTDFTLTISSLQPEDFATYYCQQ
SYSTPFTFGQGTKLEIKEPKSSDKTHTCPPCPAPPVAGPSVFLFPPKPKDTLMISRTPEVTCVVVDVKHEDPEVKFN
WYVDGVEVHNAKTKPREEQYNSTYRVVSVLTVLHQDWLNGKEYKCKVSNKALPAPIEKTISKAKGQPREPQVYTLPP
SREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Chain 3 - 6A1[B7H3]_L1 Light Chain  SEQ ID NO:1000
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 37

**>XENP34717 1A7[CD28]_H1.14_L1_Fab-2E4A3.189[B7H3]_H1.22_1A7[CD28]_L1_Fab-IgG1_pI(-
)_Isosteric_A_PVA_/S267K/L368D/K370S-IgG1_PVA_/S267K/S364K/E357Q**

Chain 1 - 1A7[CD28]_H1.14_Fab_IgG1_pI(-)_Isosteric_A_PVA_/S267K/L368D/K370S SEQ ID NO:1001
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - 2E4A3.189[B7H3]_H1.22_Fab_IgG1_PVA_/S267K/S364K/E357Q SEQ ID NO:1002
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK

Chain 3 - 1A7[CD28]_L1 Light Chain SEQ ID NO:1003
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38A

>XENP34336 1A7[CD28]_H1.14_L1_Fab-
2E4A3.189[B7H3]_H1.3_1A7[CD28]_L1_Fab_(GKPGS)2_2E4A3.189[B7H3]_H1.3_1A7[CD28]_L1_Fab-IgG1_pI(-
)_Isosteric_A_PVA_/S267K/L368D/K370S-IgG1_PVA_/S267K/S364K/E357Q
Chain 1 -1A7[CD28]_H1.14_L1_Fab-IgG1_pI(-)_Isosteric_A_PVA_/S267K/L368D/K370S SEQ ID NO:1004
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 -2E4A3.189[B7H3]_H1.3_1A7[CD28]_L1_Fab_(GKPGS)2_2E4A3.189[B7H3]_H1.3_1A7[CD28]_L1_Fab-
IgG1_PVA_/S267K/S364K/E357Q SEQ ID NO:1005
QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNHYMHWVRQAPGQGLEWMGIISPSAGSTDYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK Chain 3 -1A7[CD28]_L1 SEQ ID NO:1006
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38B

>XENP34339 1A7[CD28]_H1.14_L1_Fab-
2E4A3.189[B7H3]_H1.22_1A7[CD28]_L1_Fab_(GKPGS)2_2E4A3.189[B7H3]_H1.22_1A7[CD28]_L1_Fab-IgG1_pI(-
)_Isosteric_A_PVA_/S267K/L368D/K370S-IgG1_PVA_/S267K/S364K/E357Q Chain 1 - 1A7[CD28]_H1.14_Fab_IgG1_pI(-)_Isosteric_A_PVA_/S267K/L368D/K370S  SEQ ID NO:1007
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLPQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 -
2E4A3.189[B7H3]_H1.22_Fab_(GKPGS)2_2E4A3.189[B7H3]_H1.22_Fab_IgG1_PVA_/S267K/S364K/E357Q
 SEQ ID NO:1008
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK Chain 3 - 1A7[CD28]_L1 Light Chain  SEQ ID NO:1009
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38C

>XENP34398_1A7[CD28]_H1.14_L1_Fab-
2E4A3.189[B7H3]_H1.22_1A7_L1_Fab_(GKPGS)2_2E4A3.189[B7H3]_H1.22_1A7_L1_Fab-IgG1_pI(-
)_Isosteric_A_PVA_/S267K/L368D/K370S/M428L/N434S-IgG1_PVA_/S267K/S364K/E357Q/M428L/N434S

Chain 1 -1A7[CD28]_H1.14_L1_Fab-IgG1_pI(-)_Isosteric_A_PVA_/S267K/L368D/K370S/M428L/N434S
SEQ ID NO:1010
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

**Chain 2 -2E4A3.189[B7H3]_H1.22_1A7_L1_Fab_(GKPGS)2_2E4A3.189[B7H3]_H1.22_1A7_L1_Fab-
IgG1_PVA_/S267K/S364K/E357Q/M428L/N434S** SEQ ID NO:1011
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVLHEALHSHYTQKSLSLSPGK

Chain 3 -1A7[CD28]_L1 SEQ ID NO:1012
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38D

>XENP35611 1A7[CD28]_H1L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S-IgG1_PVA_/S267K/S364K/E357Q

Chain 1 -1A7[CD28]_H1L1_Fab-IgG1_pI(-)_Isosteric_A_PVA_/S267K/L368D/K370S SEQ ID NO:1013
EVQLLESGGGLVQPGGSLRLSCAASGFTFSSYAMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 -2E4A3.189[B7H3]_H1.22_1A7[CD28]_L1_Fab_(GKPGS)2_2E4A3.189[B7H3]_H1.22_1A7[CD28]_L1_Fab-IgG1_PVA_/S267K/S364K/E357Q SEQ ID NO:1014
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK Chain 3 -1A7[CD28]_L1 SEQ ID NO:1015
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP35612 1A7[CD28]_H1.1_L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S-IgG1_PVA_/S267K/S364K/E357Q

Chain 1 -1A7[CD28]_H1.1_L1_Fab-IgG1_pI(-)_Isosteric_A_PVA_/S267K/L368D/K370S SEQ ID NO:1016
EVQLLESGGGLVQPGGSLRLSCAASGFTFSSYYMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK Chain 2 -2E4A3.189[B7H3]_H1.22_1A7[CD28]_L1_Fab_(GKPGS)2_2E4A3.189[B7H3]_H1.22_1A7[CD28]_L1_Fab-IgG1_PVA_/S267K/S364K/E357Q SEQ ID NO:1017
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK Chain 3 -1A7[CD28]_L1 SEQ ID NO:1018
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38E

>XENP37808 1A7[CD28]_H1.1_L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S/M428L/N434S-IgG1_PVA_/S267K/S364K/E357Q/M428L/N434S Chain 1 -1A7[CD28]_H1.1_L1_Fab-IgG1_pI(-)_Isosteric_A_PVA_/S267K/L368D/K370S/M428L/N434S
SEQ ID NO:1019
EVQLLESGGGLVQPGGSLRLSCAASGFTFSSYYMSWVRQAPGKGLEWVSTISGSGDSTYYADSVKGRFTISRDNSKN
TLYLQMNSLRAEDTAVYYCAKSGPGLPQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK Chain 2 -2E4A3.189[B7H3]_H1.22_1A7[CD28]_L1_Fab_(GKPGS)2_2E4A3.189[B7H3]_H1.22_1A7[CD28]_L1_Fab-IgG1_PVA_/S267K/S364K/E357Q/M428L/N434S  SEQ ID NO:1020
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVLHEALHSHYTQKSLSLSPGK Chain 3 -1A7[CD28]_L1 SEQ ID NO:1021
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP37810 1A7[CD28]_H1.14_L1_Fab-2E4A3.189[B7H3]_H1.3_1A7[CD28]_L1_Fab_(GKPGS)2_2E4A3.189[B7H3]_H1.3_1A7[CD28]_L1_Fab-IgG1_pI(-)_Isosteric_A_PVA_/S267K/L368D/K370S/M428L/N434S-IgG1_PVA_/S267K/S364K/E357Q/M428L/N434S Chain 1 -1A7[CD28]_H1.14_L1_Fab-IgG1_pI(-)_Isosteric_A_PVA_/S267K/L368D/K370S/M428L/N434S
 SEQ ID NO:1022
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLPQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK Chain 2 -2E4A3.189[B7H3]_H1.3_1A7[CD28]_L1_Fab_(GKPGS)2_2E4A3.189[B7H3]_H1.3_1A7[CD28]_L1_Fab-IgG1_PVA_/S267K/S364K/E357Q/M428L/N434S  SEQ ID NO:1023
QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNHYMHWVRQAPGQGLEWMGIISPSAGSTDYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVLHEALHSHYTQKSLSLSPGK Chain 3 -1A7[CD28]_L1 SEQ ID NO:1024
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39A

>XENP36781 6A1[B7H3]_H1L1_Fab-6A1[B7H3]_H1L1_Fab-IgG1_pI(-
)_Isosteric_A_/PVA_/S267K/L368D/K370S/M428L/N434S-
IgG1_PVA_/S267K/S364K/E357Q/M428L/N434S/K447del_(G4S)3_1A7[CD28]_H1.14_L1_scFv(GKPGS)4

Chain 1 - 6A1[B7H3]_H1L1_Fab-IgG1_pI(-)_Isosteric_A_/PVA_/S267K/L368D/K370S/M428L/N434S
 SEQ ID NO:1025
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK Chain 2 - 6A1[B7H3]_H1L1_Fab-
IgG1_PVA_/S267K/S364K/E357Q/M428L/N434S/K447del_(G4S)3_1A7[CD28]_H1.14_L1_scFv(GKPGS)4
 SEQ ID NO:1026
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVLHEALHSHYTQKSLSLSP/GGGGGSGGGGSG
GGGS/EVQLLESGGGLVQPGGSLRLSCAASGFTFSSYYMSWVRQAPGKGLEWVSTISESGDSTYYADSVKGRFTISR
DNSKNTLYLQMNSLRAEDTAVYYCAKSGFGLRQVGFDYWGQGTLVTVSS/GKPGSGKPGSGKPGSGKPGS/DIQMTQ
SPSSLSASVGDRVTITCRASQSISSYLNWYQQKPGKAPKLLIYAASSLQSGVPSRFSGSGSGTDFTLTISSLQPEDF
ATYYCQQSYSTPFTFGQGTKLEIK Chain 3 - 6A1[B7H3]_L1  SEQ ID NO:1027
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 39B

>XENP37805 2E4A3.189[B7H3]_H1L1_Fab-2E4A3.189[B7H3]_H1L1_Fab-IgG1_pI(-
)_Isosteric_A_/PVA_/S267K/L368D/K370S/M428L/N434S-
IgG1_PVA_/S267K/S364K/E357Q/M428L/N434S/K447del_(G4S)3_1A7[CD28]_H1.14_L1_scFv(GKPGS)4

Chain 1 - 2E4A3.189[B7H3]_H1L1_Fab-IgG1_pI(-)_Isosteric_A_/PVA_/S267K/L368D/K370S/M428L/N434S
 SEQ ID NO:1028
QVQLVQSGAEVKKPGASVKVSCKASGYIFTNYYMHWVRQAPGQGLEWMGIISPSAGTTSYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK Chain 2 - 2E4A3.189[B7H3]_H1L1_Fab-
IgG1_PVA_/S267K/S364K/E357Q/M428L/N434S/K447del_(G4S)3_1A7[CD28]_H1.14_L1_scFv(GKPGS)4
 SEQ ID NO:1029
QVQLVQSGAEVKKPGASVKVSCKASGYIFTNYYMHWVRQAPGQGLEWMGIISPSAGTTSYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK Chain 3 - 2E4A3.189[B7H3]_L1 SEQ ID NO:1030
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39C

>XENP37806 2E4A3.189[B7H3]_H1.3_L1_Fab-2E4A3.189[B7H3]_H1.3_L1_Fab-IgG1_pI(-
)_Isosteric_A_/PVA_/S267K/L368D/K370S/M428L/N434S-
IgG1_PVA_/S267K/S364K/E357Q/M428L/N434S/K447del_(G4S)3_1A7[CD28]_H1.14_L1_scFv(GKPGS)4

Chain 1 - 2E4A3.189[B7H3]_H1.3_L1_Fab-IgG1_pI(-)_Isosteric_A_/PVA_/S267K/L368D/K370S/M428L/N434S
 SEQ ID NO:1031
QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK Chain 2 - 2E4A3.189[B7H3]_H1.3_L1_Fab-
IgG1_PVA_/S267K/S364K/E357Q/M428L/N434S/K447del_(G4S)3_1A7[CD28]_H1.14_L1_scFv(GKPGS)4
 SEQ ID NO:1032
QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK Chain 3 - 2E4A3.189[B7H3]_L1  SEQ ID NO:1033
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39D

>XENP37807 2E4A3.189[B7H3]_H1.22_L1_Fab-2E4A3.189[B7H3]_H1.22_L1_Fab-IgG1_pI(-
)_Isosteric_A_/PVA_/S267K/L368D/K370S/M428L/N434S-
IgG1_PVA_/S267K/S364K/E357Q/M428L/N434S/K447del_(G4S)3_1A7[CD28]_H1.14_L1_scFv(GKPGS)4

Chain 1 - 2E4A3.189[B7H3]_H1.22_L1_Fab-IgG1_pI(-)_Isosteric_A_/PVA_/S267K/L368D/K370S/M428L/N434S
SEQ ID NO:1034
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK Chain 2 - 2E4A3.189[B7H3]_H1.22_L1_Fab-
IgG1_PVA_/S267K/S364K/E357Q/M428L/N434S/K447del_(G4S)3_1A7[CD28]_H1.14_L1_scFv(GKPGS)4
SEQ ID NO:1035
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK Chain 3 - 2E4A3.189[B7H3]_L1 SEQ ID NO:1036
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39E

>XENP37982 3C4[B7H3]_H1_L1.1_Fab-3C4[B7H3]_H1_L1.1_Fab-IgG1_pI(-
)_Isosteric_A_/PVA_/S267K/L368D/K370S/M428L/N434S-
IgG1_PVA_/S267K/S364K/E357Q/M428L/N434S/K447del_(G4S)3_1A7[CD28]_H1.14_L1_scFv(GKPGS)4

Chain 1 - 3C4[B7H3]_H1_L1.1_Fab-IgG1_pI(-)_Isosteric_A_/PVA_/S267K/L368D/K370S/M428L/N434S
 SEQ ID NO:1037
QVQLVQSGAEVKKPGASVKVSCKVSGFSLTSYHVSWVRQAPGQGLEWMGAISSGGSSYYNSKFQGRVTMTRDTSTST
VYMELSSLRSEDTAVYFCTGDLGAAISWFAYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK Chain 2 - 3C4[B7H3]_H1_L1.1_Fab-
IgG1_PVA_/S267K/S364K/E357Q/M428L/N434S/K447del_(G4S)3_1A7[CD28]_H1.14_L1_scFv(GKPGS)4
 SEQ ID NO:1038
QVQLVQSGAEVKKPGASVKVSCKVSGFSLTSYHVSWVRQAPGQGLEWMGAISSGGSSYYNSKFQGRVTMTRDTSTST
VYMELSSLRSEDTAVYFCTGDLGAAISWFAYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK Chain 3 - 3C4[B7H3]_L1.1 SEQ ID NO:1039
DIQMTQSPSSLSASVGDRVTITCRTSQSIYKSLAWYQQKPGKAPKLLIYNAHSLQTGIPSRFSGSGSGTDFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC → XENP34717 B7H3 (2E4A3.189_H1.3) x CD28 (1A7) (1+1 CLC)
→ XENP34336 B7H3 (2E4A3.189_H1.3) x CD28 (1A7 440 nM) (2+1 CLC)
→ XENP34339 B7H3 (2E4A3.189_H1.22) x CD28 (1A7 77 nM) (2+1 CLC)
→ XENP35611 B7H3 (2E4A3.189_H1.22) x CD28 (1A7_H1L1 610 nM) (2+1 CLC)
→ XENP35612 B7H3 (2E4A3.189_H1.22) x CD28 (1A7_H1.1_L1 270 nM) (2+1 CLC)

- XENP34398 [2+1 CLC] - 2E4A3.189[B7H3]_H1.22_1A7_L1 x 1A7[CD28]_H1.14_L1 + Xtend
- XENP37808 [2+1 CLC] - 2E4A3.189[B7H3]_H1.22_1A7_L1 x 1A7[CD28]_H1.1_L1 + Xtend
- XENP37810 [2+1 CLC] - 2E4A3.189[B7H3]_H1.3_1A7_L1 x 1A7[CD28]_H1.14_L1 + Xtend
- XENP34732 [1+1 Fab-scFv-Fc] - 6A1[B7H3]_H1L1 x 1A7[CD28]_H1.14_L1 + Xtend
- XENP35151 [1+1 Fab-scFv-Fc] - 4F12[B7H3]_H2_L1.1 x 1A7[CD28]_H1.14_L1 + Xtend
- XENP35153 [1+1 Fab-scFv-Fc] - 38E2[B7H3]_H2_L1.1 x 1A7[CD28]_H1.14_L1 + Xtend
- XENP37807 [2+1 mAb-scFv] - 2E4A3.189[B7H3]_H1.22_L1 x 1A7[CD28]_H1.14_L1 + Xtend
- XENP37082 [2+1 mAb-scFv] - 3C4[B7H3]_H1_L1.1 x 1A7[CD28]_H1.14_L1 + Xtend → XENP34398 [2+1 CLC] - 2E4A3.189[B7H3]_H1.22_1A7_L1 x 1A7[CD28]_H1.14_L1 + Xtend
→ XENP37808 [2+1 CLC] - 2E4A3.189[B7H3]_H1.22_1A7_L1 x 1A7[CD28]_H1.1_L1 + Xtend
→ XENP37810 [2+1 CLC] - 2E4A3.189[B7H3]_H1.3_1A7_L1 x 1A7[CD28]_H1.14_L1 + Xtend
→ XENP34732 [1+1 Fab-scFv-Fc] - 6A1[B7H3]_H1L1 x 1A7[CD28]_H1.14_L1 + Xtend
→ XENP35151 [1+1 Fab-scFv-Fc] - 4F12[B7H3]_H2_L1.1 x 1A7[CD28]_H1.14_L1 + Xtend
→ XENP35153 [1+1 Fab-scFv-Fc] - 38E2[B7H3]_H2_L1.1 x 1A7[CD28]_H1.14_L1 + Xtend
→ XENP37807 [2+1 mAb-scFv] - 2E4A3.189[B7H3]_H1.22_L1 x 1A7[CD28]_H1.14_L1 + Xtend
→ XENP37982 [2+1 mAb-scFv] - 3C4[B7H3]_H1_L1.1 x 1A7[CD28]_H1.14_L1 + Xtend

Figure 44

| 1A7 VH | SEQ | SEQ ID | |
|---|---|---|---|
| HFR1 | EVQLLESGGGLVQPGGSLRLSCAASGF$X_1X_2X_3$ | 1184 | $X_1$ is selected from T,S,N; $X_2$ is selected from F, L; and $X_3$ is selected from S, E, R, K, G, T, A, N |
| HCDR1 | $X_1X_2X_3X_4X_5$ | 1185 | $X_1$ is selected from S, G, E, T, D, A, R, K; $X_2$ is selected from Y, N; $X_3$ is selected from A, Y, S; $X_4$ is selected from M, I; and $X_5$ is selected from S, T, N |
| HFR2 | WVRQAPGKGLEWV$X_1$ | 1186 | $X_1$ is selected from S, A |
| HCDR2 | $X_1IX_2X_3X_4X_5X_6X_7$TYYADSVKG | 1187 | $X_1$ is selected from T, S; $X_2$ is selected from S, D, E, Y, T; $X_3$ is selected from G, D, E, A, Y, S, N, T; $X_4$ is selected from S, D, N, G; $X_5$ is selected from D, T, Y, S, A; $X_6$ is selected from D, T, Y, S, A; and $X_7$ is selected from S, Y, A, T, D, N |
| HFR3 | RFTISRDNSKNTLYLQMNSLRAEDTAVYYCAK | 1188 | |
| HCDR3 | SGPGLRQVGFDY | 1189 | |
| HFR4 | WGQGTLVTVSS | 1190 | |
| 1A7 VL | | | |
| LFR1 | DIQMTQSPSSLSASVGDRVTITC | 1191 | |
| LCDR1 | RASQSIS$X_1X_2$L$X_3$ | 1192 | $X_1$ is selected from S, A, D, G, H, K, N, Q, T, V, Y; $X_2$ is selected from Y, A, D, F, H, K, L, N, Q, S, W; and $X_3$ is selected from N, A, D, G, H, Q, S, T, Y |
| LFR2 | WYQQKPGKAPKLLIY | 1193 | |
| LCDR2 | $X_1$AS$X_2$L$X_3X_4$ | 1194 | $X_1$ is selected from A, D, G, K, L, Q, S, T, W, Y; $X_2$ is selected from S, A, D, K, N, Q, T, Y; $X_3$ is selected from Q, A, E, F, H, I, K, N, S, V, Y; and $X_4$ is selected from Q, A, E, F, H, I, K, N, S, V, Y |
| LFR3 | GVPSRFSGSGSGTDFTLTISSLQPEDFATYYC | 1195 | |
| LCDR3 | QQ$X_1X_2X_3X_4$P$X_5$T | 1196 | $X_1$ is selected from S, A, D, F, H, K, L, T, V, Y; $X_2$ is selected from Y, A, D, F, H, K, L, Q, V, W; $X_3$ is selected from S, A, D, G, H, K, N, Q, T, V, Y; $X_4$ is selected from T, A, D, F, I, K, L, Q, S, V, Y; and $X_5$ is selected from F, I, L, W |
| LFR4 | FGQGTKLEIK | 1197 | |

Figure 45A
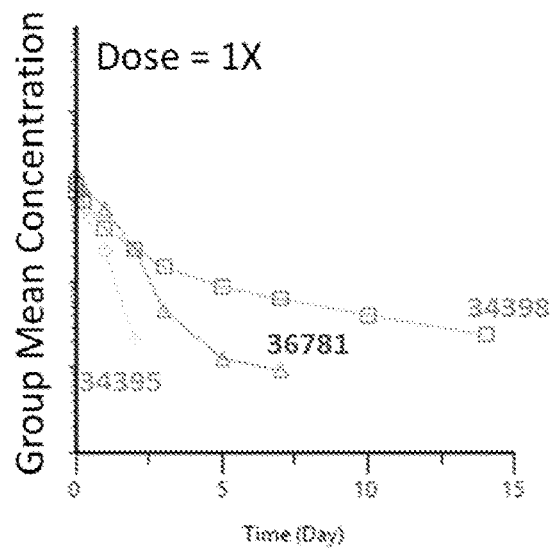
Figure 45B
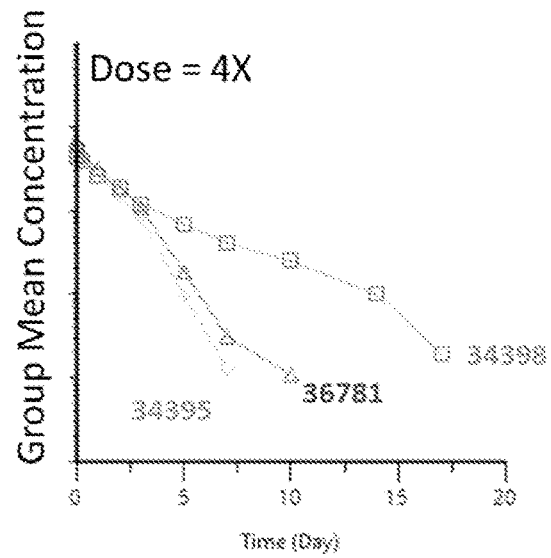
Figure 45C
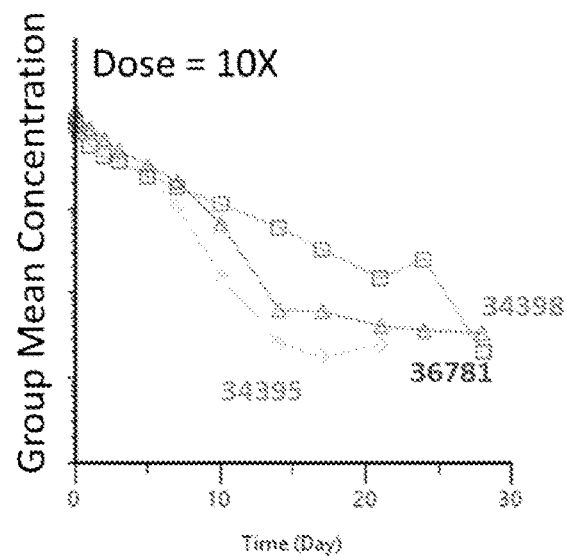
Figure 45D
XENP34398: 2 + 1 CLC
XENP36781: 2 + 1 mAb-scFv
XENP34395: 2 + 1 $Fab_2$-scFv-Fc

Figure 47

|  | XENP34398 | XENP37808 | XENP34732 | XENP35153 |
|---|---|---|---|---|
| Format | 2+1 CLC | 2+1 CLC | 1 + 1 Fab-scFv-Fc | 1 + 1 Fab-scFv-Fc |
| B7H3 Fv | 2E4A3.189[B7H3]_H1.22_1A7_L1 | 2E4A3.189[B7H3]_H1.22_1A7_L1 | 6A1[B7H3]_H1_L1 | 4F12[B7H3]_H2_L1.1 |
| CD28 Fv | 1A7[CD28]_H1.14_L1 | 1A7[CD28]_H1.1_L1 | 1A7[CD28]_H1.14_L1 | 1A7[CD28]_H1.14_L1 |
| B7H3 Fv Source | Phage | Phage | Rat | Rabbit |
| CD28 Fv Source | Phage | Phage | Phage | Phage |
| B7H3 Fv Humanness | 93% | 93% | 85% | 81% |
| CD28 Fv Humanness | 94% | 94% | 94% | 94% |
| B7H3 Monovalent KD (nM) | 7.6 | 7.6 | 8.1 | 0.5 |
| CD28 KD (nM) | 63 | 230 | 370 | 360 |
| MDA-MB-231 EC50 (nM) | 0.2 | 0.7 | 6 | 0.6 |
| PK t1/2 | 3.3 to 5.0 | 3.4 to 4.3 | 5.4 to 6.1 | 4.2 to 5.4 |
| DSF Tm1 and Tm2 (oC) | 67.5, 78.5 | 67.5, 78.5 | 67.5, 80.0 | 67.5, 79.0 |
| Sequence Liabilities | none | none | none | NS (HCDR3); NS (LCDR1) |
| Pros | most potent; high humanness | high humanness | simplest bsAb format | simplest bsAb format |
| Cons |  |  | weak activity | rabbit-derived |

Figure 54A

>XENP31602 PSMA-H_H1L1_Fab-PSMA-H_H1L1_CH1_(G4S)2_[CD3]_H1.30_L1.47_scFv(GKPGS)4_(G4S)2-IgG1_pI(-)_Isosteric_A_/PVA_/S267K/L368D/K370S-Fc(222)_IgG1_PVA_/S267K/S364K/E357Q Chain 1 - PSMA-H_H1_IgG1_pI(-)_Isosteric_A_/PVA_/S267K/L368D/K370S  SEQ ID NO:1040
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK Chain 2 - PSMA-H_H1_CH1_(G4S)2_[CD3]_H1.30_L1.47_scFv(GKPGS)4_(G4S)2_Fc(222)_IgG1_PVA_/S267K/S364K/E357Q
 SEQ ID NO:1041
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK Chain 3 - PSMA-H_L1 Light Chain  SEQ ID NO:1042
DIVMTQSPDSLAVSLGERATLSCRASQDVGTAVDWYQQKPDQSPKLLIYWASTRHTGVPDRFTGSGSGTDFTLTISS
LQAEDVAVYFCQQYNSYPLTFGAGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 54B

>XENP32220 PSMA-H_H1_L1.24_Fab-PSMA-H_H1_L1.24_Fab_(G4S)_[CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q Chain 1 - PSMA-H_H1_IgG1_pI(-)_Isosteric_A_/PVA_/S267K/L368D/K370S  SEQ ID NO:1043
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK Chain 2 - PSMA-H_H1_(G4S)_[CD3]_L1.47_H1.32_scFv(GKPGS)4_Fc(222)_IgG1_C220S/PVA_/S267K/S364K/E357Q
SEQ ID NO:1044
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK Chain 3 - PSMA-H_L1.24 Light Chain  SEQ ID NO:1045
DIVMTQSPDSLAVSLGERATLSCRASQDVGTAVDWYQQKPDQSPKLLIYYASTPHTGVPDRFTGSGSGTDFTLTISS
LQAEDVAVYFCQQYNSYPLTFGAGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC 1) 1 µg/ml XENP31602
2) 1 µg/ml XENP34339

Figure 56A

| | Sequence | SEQ ID NO: |
|---|---|---|
| CD3 High – [anti-CD3]_H1.30_L1.47_scFv | | |
| scFv | EVQLVESGGGLVQPGGSLRLSCAASGFTFSTYAMNWVRQAPGKGLEWVGRIRSKY NNYATYYADSVKGRFTISRDDSKNTLYLQMNSLRAEDTAVYYCVRHGNFGDSYVS WFAYWGQGTLVTVSS/GKPGSGKPGSGKPGSGKPGS/QAVVTQEPSLTVSPGGTV TLTCGSSTGAVTTSNYANWVQQKPGKSPRGLIGGTNKRAPGVPARFSGSLLGGKA ALTISGAQPEDEADYYCALWYSNHWVFGGGTKLTVL | SEQ ID NO:1046 |
| Variable Heavy (vh) Domain | EVQLVESGGGLVQPGGSLRLSCAASGFTFSTYAMNWVRQAPGKGLEWVGRIRSKY NNYATYYADSVKGRFTISRDDSKNTLYLQMNSLRAEDTAVYYCVRHGNFGDSYVS WFAYWGQGTLVTVSS | SEQ ID NO:1047 |
| vhCDR1 | TYAMN | SEQ ID NO:1048 |
| vhCDR2 | RIRSKYNNYATYYADSVKG | SEQ ID NO:1049 |
| vhCDR3 | HGNFGDSYVSWFAY | SEQ ID NO:1050 |
| Variable Light (vl) Domain | QAVVTQEPSLTVSPGGTVTLTCGSSTGAVTTSNYANWVQQKPGKSPRGLIGGTNK RAPGVPARFSGSLLGGKAALTISGAQPEDEADYYCALWYSNHWVFGGGTKLTVL | SEQ ID NO:1051 |
| vlCDR1 | GSSTGAVTTSNYAN | SEQ ID NO:1052 |
| vlCDR2 | GTNKRAP | SEQ ID NO:1053 |
| vlCDR3 | ALWYSNHWV | SEQ ID NO:1054 |
| Linker | GKPGSGKPGSGKPGSGKPGS | SEQ ID NO:1055 |

Figure 56B

| CD3 High-Int #1 – [anti-CD3]_H1.32_L1.47_scFv | | |
|---|---|---|
| | Sequence | SEQ ID NO: |
| scFv | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWQQKPGKSPRGLIGGTNKPAPGVPARFSGSLLGGKAALTISGAQPEDEADYYCALWYSNHWVFGGGTKLTVL | SEQ ID NO:1056 |
| Variable Heavy (vh) Domain | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | SEQ ID NO:1057 |
| vhCDR1 | TYAMN | SEQ ID NO:1058 |
| vhCDR2 | RIRSKANNYATYYADSVKG | SEQ ID NO:1059 |
| vhCDR3 | HGNFGDSYVSWFAY | SEQ ID NO:1060 |
| Variable Light (vl) Domain | QAVVTQEPSLTVSPGGTVTLTCGSSTGAVTTSNYANWQQKPGKSPRGLIGGTNKPAPGVPARFSGSLLGGKAALTISGAQPEDEADYYCALWYSNHWVFGGGTKLTVL | SEQ ID NO:1061 |
| vlCDR1 | GSSTGAVTTSNYAN | SEQ ID NO:1062 |
| vlCDR2 | GTNKPAP | SEQ ID NO:1063 |
| vlCDR3 | ALWYSNHWV | SEQ ID NO:1064 |
| Linker | GKPGSGKPGSGKPGSGKPGS | SEQ ID NO:1065 |

Figure 56C

| CD3 High-Int #2 – [anti-CD3] H1.89_L1.47_scFv | | |
|---|---|---|
| | Sequence | SEQ ID NO: |
| scFv | EVQLVESGGGLVQPGGSLRLSCAASGFTFSTYAMNWVRQAPGKGLEWVGRIRSK YNNYATYYADSVKGRFTISRDDSKNTLYLQMNSLRAEDTAVYYCVRHGNFGDEY VSWFAYWGQGTLVTVSS/GKPGSGKPGSGKPGSGKPGS/QAVVTQEPSLTVSPG GTVTLTCGSSTGAVTTSNYANWVQQKPGKSPRGLIGGTNKPAPGVPARFSGSLL GGKAALTISGAQPEDEADYYCALWYSNHWVFGGGTKLTVL | SEQ ID NO:1066 |
| Variable Heavy (vh) Domain | EVQLVESGGGLVQPGGSLRLSCAASGFTFSTYAMNWVRQAPGKGLEWVGRIRSK YNNYATYYADSVKGRFTISRDDSKNTLYLQMNSLRAEDTAVYYCVRHGNFGDEY VSWFAYWGQGTLVTVSS | SEQ ID NO:1067 |
| vhCDR1 | TYAMN | SEQ ID NO:1068 |
| vhCDR2 | RIRSKYNNYATYYADSVKG | SEQ ID NO:1069 |
| vhCDR3 | HGNFGDEYVSWFAY | SEQ ID NO:1070 |
| Variable Light (vl) Domain | QAVVTQEPSLTVSPGGTVTLTCGSSTGAVTTSNYANWVQQKPGKSPRGLIGGTN KPAPGVPARFSGSLLGGKAALTISGAQPEDEADYYCALWYSNHWVFGGGTKLTV L | SEQ ID NO:1071 |
| vlCDR1 | GSSTGAVTTSNYAN | SEQ ID NO:1072 |
| vlCDR2 | GTNKPAP | SEQ ID NO:1073 |
| vlCDR3 | ALWYSNHWV | SEQ ID NO:1074 |
| Linker | GKPGSGKPGSGKPGSGKPGS | SEQ ID NO:1075 |

Figure 56D

| CD3 High-Int – [anti-CD3] H1.90 L1.47 scFv | | |
|---|---|---|
| | Sequence | SEQ ID NO: |
| scFv | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKPAPGVPARFSGSLLGGKAALTISGAQPEDEADYYCALWYSNHWVFGGGTKLTVL | SEQ ID NO:1076 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | SEQ ID NO:1077 |
| vhCDR1 | TYAMN | SEQ ID NO:1078 |
| vhCDR2 | RIRSKYNNYATYYADSVKG | SEQ ID NO:1079 |
| vhCDR3 | HGNFGDPYVSWFAY | SEQ ID NO:1080 |
| Variable Light (vl) Domain | QAVVTQEPSLTVSPGGTVTLTCGSSTGAVTTSNYANWVQQKPGKSPRGLIGGTNKPAPGVPARFSGSLLGGKAALTISGAQPEDEADYYCALWYSNHWVFGGGTKLTVL | SEQ ID NO:1081 |
| vlCDR1 | GSSTGAVTTSNYAN | SEQ ID NO:1082 |
| vlCDR2 | GTNKPAP | SEQ ID NO:1083 |
| vlCDR3 | ALWYSNHWV | SEQ ID NO:1084 |
| Linker | GKPGSGKPGSGKPGSGKPGS | SEQ ID NO:1085 |

Figure 56E

| Anti-CD3-Intermediate – [anti-CD3]_H1.33_L1.47_scFv ||| 
|---|---|---|
| | Sequence | SEQ ID NO: |
| scFv | EVQLVESGGGLVQPGGSLRLSCAASGFTFSTYAMNWVRQAPGKGLEWVGRIRSK YNNYATYYADSVKGRFTISRDDSKNTLYLQMNSLRAEDTAVYYCVRHGNFGDSY VSWFDYWGQGTLVTVSS/GKPGSGKPGSGKPGSGKPGS/QAVVTQEPSLTVSPG GTVTLTCGSSTGAVTTSNYANWVQQKPGKSPRGLIGGTNKPAPGVPARFSGSLL GGKAALTISGAQPEDEADYYCALWYSNHWVFGGGTKLTVL | SEQ ID NO:1086 |
| Variable Heavy (vh) Domain | EVQLVESGGGLVQPGGSLRLSCAASGFTFSTYAMNWVRQAPGKGLEWVGRIRSK YNNYATYYADSVKGRFTISRDDSKNTLYLQMNSLRAEDTAVYYCVRHGNFGDSY VSWFDYWGQGTLVTVSS | SEQ ID NO:1087 |
| vhCDR1 | TYAMN | SEQ ID NO:1088 |
| vhCDR2 | RIRSKYNNYATYYADSVKG | SEQ ID NO:1089 |
| vhCDR3 | HGNFGDSYVSWFDY | SEQ ID NO:1090 |
| Variable Light (vl) Domain | QAVVTQEPSLTVSPGGTVTLTCGSSTGAVTTSNYANWVQQKPGKSPRGLIGGTN KPAPGVPARFSGSLLGGKAALTISGAQPEDEADYYCALWYSNHWVFGGGTKLTV L | SEQ ID NO:1091 |
| vlCDR1 | GSSTGAVTTSNYAN | SEQ ID NO:1092 |
| vlCDR2 | GTNKPAP | SEQ ID NO:1093 |
| vlCDR3 | ALWYSNHWV | SEQ ID NO:1094 |
| Linker | GKPGSGKPGSGKPGSGKPGS | SEQ ID NO:1095 |

Figure 56F

| CD3 High-Int – [anti-CD3]_H1.31_L1.47_scFv | | |
|---|---|---|
| | Sequence | SEQ ID NO: |
| scFv | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKPAPGVPARFSGSLLGGKAALTISGAQPEDEADYYCALWYSNHWVFGGGTKLTVL | SEQ ID NO:1096 |
| Variable Heavy (vh) Domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1097 |
| vhCDR1 | TYAMS | SEQ ID NO:1098 |
| vhCDR2 | RIRSKYNNYATYYADSVKG | SEQ ID NO:1099 |
| vhCDR3 | HGNFGDSYVSWFAY | SEQ ID NO:1100 |
| Variable Light (vl) Domain | QAVVTQEPSLTVSPGGTVTLTCGSSTGAVTTSNYANWVQQKPGKSPRGLIGGTNKPAPGVPARFSGSLLGGKAALTISGAQPEDEADYYCALWYSNHWVFGGGTKLTVL | SEQ ID NO:1101 |
| vlCDR1 | GSSTGAVTTSNYAN | SEQ ID NO:1102 |
| vlCDR2 | GTNKPAP | SEQ ID NO:1103 |
| vlCDR3 | ALWYSNHWV | SEQ ID NO:1104 |
| Linker | GKPGSGKPGSGKPGSGKPGS | SEQ ID NO:1105 |

Figure 56G

| CD3 High[VL-VH] – [anti-CD3] L1.47 H1.30 scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1106 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1107 |
| vlCDR1 | GSSTGAVTTSNYAN | SEQ ID NO:1108 |
| vlCDR2 | GTNKRAP | SEQ ID NO:1109 |
| vlCDR3 | ALWYSNHWV | SEQ ID NO:1110 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1111 |
| vhCDR1 | TYAMN | SEQ ID NO:1112 |
| vhCDR2 | RIRSKYNNYATYYADSVKG | SEQ ID NO:1113 |
| vhCDR3 | HGNFGDSYVSWFAY | SEQ ID NO:1114 |
| Linker | GKPGSGKPGSGKPGSGKPGS | SEQ ID NO:1115 |

Figure 56H

| CD3 High-Int #1[VL-VH] – [anti-CD3] L1.47 H1.32 scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | SEQ ID NO:1116 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1117 |
| vlCDR1 | GSSTGAVTTSNYAN | SEQ ID NO:1118 |
| vlCDR2 | GTNKRAP | SEQ ID NO:1119 |
| vlCDR3 | ALWYSNHWV | SEQ ID NO:1120 |
| Variable Heavy (vh) Domain | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | SEQ ID NO:1121 |
| vhCDR1 | TYAMN | SEQ ID NO:1122 |
| vhCDR2 | RIRSKANNYATYYADSVKG | SEQ ID NO:1123 |
| vhCDR3 | HGNFGDSYVSWFAY | SEQ ID NO:1124 |
| Linker | GKPGSGKPGSGKPGSGKPGS | SEQ ID NO:1125 |

Figure 56I

| CD3 High-Int #2[VL-VH] – [anti-CD3] L1.47_H1.89_scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | SEQ ID NO:1126 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1127 |
| vlCDR1 | GSSTGAVTTSNYAN | SEQ ID NO:1128 |
| vlCDR2 | GTNKRAP | SEQ ID NO:1129 |
| vlCDR3 | ALWYSNHWV | SEQ ID NO:1130 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | SEQ ID NO:1131 |
| vhCDR1 | TYAMN | SEQ ID NO:1132 |
| vhCDR2 | RIRSKYNNYATYYADSVKG | SEQ ID NO:1133 |
| vhCDR3 | HGNFGDEYVSWFAY | SEQ ID NO:1134 |
| Linker | GKPGSGKPGSGKPGSGKPGS | SEQ ID NO:1135 |

Figure 56J

| | Sequence | SEQ ID NO: |
|---|---|---|
| CD3 High-Int[VL-VH] – [anti-CD3] L1.47_H1.90_scFv | | |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | SEQ ID NO:1136 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1137 |
| vlCDR1 | GSSTGAVTTSNYAN | SEQ ID NO:1138 |
| vlCDR2 | GTNKRAP | SEQ ID NO:1139 |
| vlCDR3 | ALWYSNHWV | SEQ ID NO:1140 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | SEQ ID NO:1141 |
| vhCDR1 | TYAMN | SEQ ID NO:1142 |
| vhCDR2 | RIRSKYNNYATYYADSVKG | SEQ ID NO:1143 |
| vhCDR3 | HGNFGDPYVSWFAY | SEQ ID NO:1144 |
| Linker | GKPGSGKPGSGKPGSGKPGS | SEQ ID NO:1145 |

Figure 56K

| Anti-CD3-Intermediate[VL-VH] – [anti-CD3] L1.47_H1.33_scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | SEQ ID NO:1146 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1147 |
| vlCDR1 | GSSTGAVTTSNYAN | SEQ ID NO:1148 |
| vlCDR2 | GTNKRAP | SEQ ID NO:1149 |
| vlCDR3 | ALWYSNHWV | SEQ ID NO:1150 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | SEQ ID NO:1151 |
| vhCDR1 | TYAMN | SEQ ID NO:1152 |
| vhCDR2 | RIRSKYNNYATYYADSVKG | SEQ ID NO:1153 |
| vhCDR3 | HGNFGDSYVSWFDY | SEQ ID NO:1154 |
| Linker | GKPGSGKPGSGKPGSGKPGS | SEQ ID NO:1155 |

Figure 56L

| CD3 High-Int[VL-VH] – [anti-CD3]_L1.47_H1.31_scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1156 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1157 |
| vlCDR1 | GSSTGAVTTSNYAN | SEQ ID NO:1158 |
| vlCDR2 | GTNKRAP | SEQ ID NO:1159 |
| vlCDR3 | ALWYSNHWV | SEQ ID NO:1160 |
| Variable Heavy (vh) Domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1161 |
| vhCDR1 | TYAMS | SEQ ID NO:1162 |
| vhCDR2 | RIRSKYNNYATYYADSVKG | SEQ ID NO:1163 |
| vhCDR3 | HGNFGDSYVSWFAY | SEQ ID NO:1164 |
| Linker | GKPGSGKPGSGKPGSGKPGS | SEQ ID NO:1165 |

Figure 57A
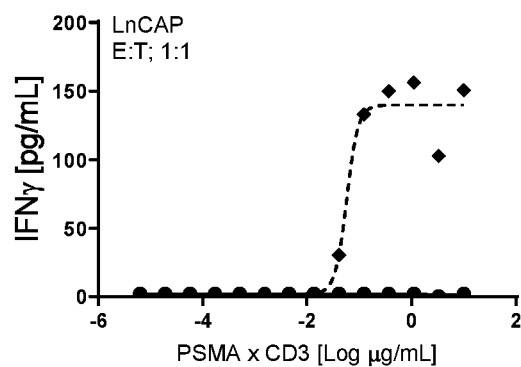
Figure 57B
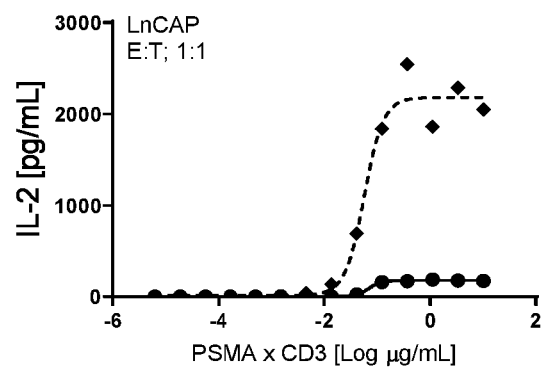
Figure 57C
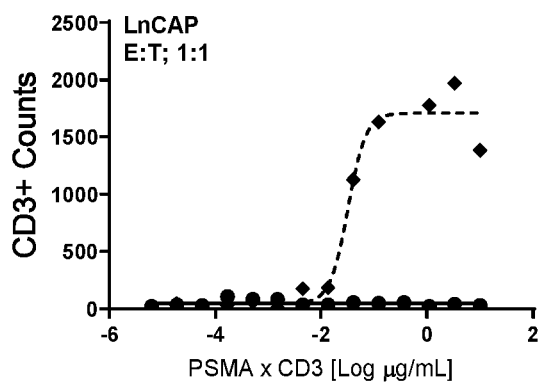
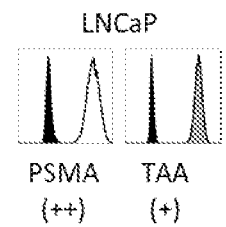

- PBS
- CD3bsAb1, 0.5 mg/Kg
- CD3bsAb2, 0.5 mg/Kg
- XENP34339, 5 mg/Kg + CD3bsAb1, 0.5 mg/Kg
- XENP34339, 5 mg/Kg + CD3bsAb2, 0.5 mg/Kg

✗ (A) huPBMC + PBS
○ (B) XENP34339 - 0.3 mg/kg

PSMAxCD3
▲ (D) XENP32220 - 1 mg/kg
■ (F) XENP 32220 - 6 mg/kg

PSMAxCD3 + B7H3xCD28
● (G) XENP32220, 1 mg/kg + XENP34339, 0.3 mg/Kg
◆ (H) XENP32220, 6 mg/kg + XENP34339, 0.3 mg/Kg

| | PSMAxCD3 | PSMAxCD3 + B7H3xCD28 |
|---|---|---|
| X (A) huPBMC + PBS | ▲ (D) XENP32220 - 1 mg/kg | ● (G) XENP32220, 1 mg/kg + XENP34339, 0.3 mg/Kg |
| O (B) XENP34339 - 0.3 mg/kg | ■ (F) XENP 32220 - 6 mg/kg | ◆ (H) XENP32220, 6 mg/kg + XENP34339, 0.3 mg/Kg |

Figure 69
>XENP29154_TGN1412_hu5.11A1[CD28]_H1L1_IgG4_K447del
XENP29154_TGN1412_hu5.11A1[CD28]_H1_IgG4_K447del Heavy Chain SEQ ID NO:1166
EVQLVESGGGLVQPGGSLRLSCAASGFTFSDSWIHWVRQAPGKGLEWVAWISPYGGSTYYADSVKGRFTI
SADTSKNTAYLQMNSLRAEDTAVYYCARRHWPGGFDYWGQGTLVTVSS/ASTKGPSVFPLAPSSKSTSGG
TAALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK

XENP29154 TGN1412_hu5.11A1[CD28]_ L1 Light Chain SEQ ID NO:1167
DIQMTQSPSSLSASVGDRVTITCRASQDVSTAVAWYQQKPGKAPKLLIYSASFLYSGVPSRFSGSGSGTD
FTLTISSLQPEDFATYYCQQYLYHPATFGQGTKVEIK/RTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTKSF
NRGEC

● PBS
■ XENP34339
♦ TGN1412 (XENP29154)

● PBS
▲ XENP37808 [10ug/well]
■ TGN1412 IgG4 [10ug/well]

▲ anti-CD3 scFv transfected HEK cells B7H3+
● anti-CD3 scFv transfected HEK cells B7H3-

Figure 75

| 2E4A3.189 VH | SEQ | SEQ ID | |
|---|---|---|---|
| HFR1 | QVQLVQSGAEVKKPGASVKVSCKASG$X_1X_2FX_3$ | 1168 | $X_1$ is selected from Y, L; $X_2$ is selected from I, T, P, A, S, G, L, F; and $X_3$ is selected from T, I, V, K, E, S |
| HCDR1 | $X_1X_2$YMH | 1169 | $X_1$ is selected from N, D, Q, E, I, F; and $X_2$ is selected from Y, N, H, F, V |
| HFR2 | WVRQAPGQGLEWMG | 1170 | |
| HCDR2 | I$X_1X_2$P$X_3X_4$G$X_5X_6X_7$YAQKFQG | 1171 | X1 is selected from I, L; X2 is selected from S, A, F, G; X3 is selected from S, I, V, L, Q, A, G; X4 is selected from A, S, V, G, T; X5 is selected from T, R, S; X6 is selected from T, W, I; and X7 is selected from S, D, A, N, I, L, Q |
| HFR3 | R$X_1$TMTRDTSTSTVYMELSSLRSEDTAVYYCAR | 1172 | X1 is selected from V, F |
| HCDR3 | $X_1$G$X_2$SSPR$X_3$DY | 1173 | X1 is selected from G, A; X2 is selected from G, F, W, L, M; and X3 is selected from L, S, V, G, Q |
| HFR4 | WGQGTLVTVSS | 1174 | |
| 2E4A3.189 VL | | | |
| LFR1 | DIQMTQSPSSLSASVGDRVTITC | 1175 | |
| LCDR1 | RASQSISSYLN | 1176 | |
| LFR2 | WYQQKPGKAPKLLIY | 1177 | |
| LCDR2 | AASSLQS | 1178 | |
| LFR3 | GVPSRFSGSGSGTDFTLTISSLQPEDFATYYC | 1179 | |
| LCDR3 | QQSYSTPYT | 1180 | |
| LFR4 | FGQGTKLEIK | 1181 | |

ANTI-CD28 COMPOSITIONS

PRIORITY

This application is a continuation of U.S. patent application Ser. No. 17/407,135, filed Aug. 19, 2021 which claims the benefit of U.S. Provisional Patent Application Nos. 63/067,834, filed Aug. 19, 2020 and 63/092,272, filed Oct. 15, 2020 which are hereby incorporated by reference in their entireties.

SEQUENCE LISTING INCORPORATION PARAGRAPH

The instant application contains a Sequence Listing which has been submitted electronically in ASCII format and is hereby incorporated by reference in its entirety. Said ASCII copy, created on Aug. 19, 2021, is named 067461-5272-WO_SL.txt and is 1,130,417 bytes in size.

BACKGROUND

The natural immune response against tumor dispatches immune effector cells such as natural killer (NK) cells and T cells to attack and destroy tumor cells. Tumor infiltrating lymphocytes (TILs) often express multiple immune checkpoint receptors (e.g., PD-1, CTLA-4) and costimulatory receptors (e.g., ICOS, 4-1BB, OX40, GITR, and CD28). TILs lose their cytotoxic ability over time due to upregulation of inhibitory immune checkpoints. While checkpoint blockade has demonstrated increased clinical response rates relative to other treatment options, many patients still fail to achieve a response to checkpoint blockade. Engagement of costimulatory receptors on TILs could provide a positive signal capable of overcoming negative signals of immune checkpoints. Preclinical and clinical studies of agonistic costimulatory receptor antibodies have indeed demonstrated that agonism of costimulatory receptors can result in impressive anti-tumor responses, activating T cells to attack tumor cells.

It is also important for cancer therapy to enhance anti-tumor activity by specifically destroying tumor cells while minimizing peripheral toxicity. In this context, it is crucial that only T cells in the presence of the target tumor cells are provided a costimulatory signal. However, agonism of costimulatory receptors with monospecific full-length antibodies is likely nondiscriminatory with regards to TILs vs. peripheral T cells vs. autoantigen-reactive T cells that contribute to autoimmune toxicities. For instance, urelumab, a monospecific, nondiscriminatory, pan-4-1BB agonist antibody, exhibited significant liver toxicity in early phase clinical trials (Segal et al., 2016). Thus, there remains a need for novel immune response enhancing compositions for the treatment of cancers.

SUMMARY

Provided herein are novel anti-CD28 compositions, including anti-CD28×anti-TAA (e.g., αCD28×αB7H3) antibodies and methods of using such antibodies for the treatment of cancers. Subject anti-CD28×anti-TAA antibodies are capable of agonistically binding to CD28 costimulatory molecules on T cells and a tumor associated antigen (e.g., B7H3) on tumor cells. Thus, such antibodies selectively enhance anti-tumor activity at tumor sites while minimizing peripheral toxicity. The subject antibodies provided herein are particularly useful in combination with other anti-cancer therapies, including, for example, checkpoint inhibitors. Also provided herein are novel αCD28 and αB7H3 binding domains.

In a first aspect, provided herein is a heterodimeric antibody comprising: a) a first monomer comprising, from N-terminus to C-terminus, a VH1-CH1-linker-VH1-CH1-hinge-CH2-CH3, wherein the VH1s are each a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-CH3 is a second Fc domain; and c) a common light chain comprising, from N-terminus to C-terminus, VL-CL, wherein VL is a variable light domain and CL is a constant light domain, wherein the common light chain is separately paired with each VH1-CH1 in the first monomer and the VH2-CH1 in the second monomer, wherein the VH1 and the VL together form a first antigen binding domain (ABD), and the VH2 and the VL together form a second ABD, wherein one of the first and second ABDs binds human CD28 and the other of the first and second ABDs bind human B7H3.

In some embodiments, the first ABD binds human CD28 and the second binds human B7H3. In certain embodiments, the first ABD binds human B7H3 and the second binds human CD28.

In some embodiments, the amino acid sequence of the VH1 domain is selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and wherein the amino acid sequence of the VL domain is SEQ ID NO:874.

In some embodiments, the amino acid sequence of the VH2 domain is selected from the group consisting of SEQ ID NO: 585, SEQ ID NO:870, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651.

In certain embodiments, the first Fc domain and second Fc domain are each variant Fc domains.

In some embodiments of the heterodimeric antibody, the first and second Fc domains comprise a set of heterodimerization skew variants selected from the following heterodimerization variants: S364K/E357Q:L368D/K370S; S364K:L368D/K370S; S364K:L368E/K370S; D401K: T411E/K360E/Q362E; and T366W:T366S/L368A/Y407V, wherein numbering is according to EU numbering. In exemplary embodiments, the first and second Fc domains comprise heterodimerization skew variants S364K/E357Q: L368D/K370S.

In some embodiments, the first and second Fc domains each comprise one or more ablation variants. In some embodiments, the one or more ablation variants are E233P/L234V/L235A/G236del/S267K, wherein numbering is according to EU numbering.

In some embodiments, one of the first or second monomer further comprises a pI variant. In some embodiments, the CH1-hinge-CH2-CH3 of the second monomer comprises pI variants N208D/Q295E/N384D/Q418E/N421D, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/S267K, and the first Fc domain comprises amino acid variants S364K/E357Q/E233P/L234V/L235A/G236del/S267K, wherein numbering is according to EU numbering.

In exemplary embodiments, the first and second variant Fc domains each comprise amino acid variants 428L/434S.

In some embodiments, the second monomer comprises the amino acid sequence of SEQ ID NO:1019, the first monomer comprises the amino acid sequence of SEQ ID NO:1020, and the light chain has the amino acid sequence of SEQ ID NO:1021.

In another aspect, provided herein is a heterodimeric antibody comprising: a) a first monomer comprising, from N-terminus to C-terminus, a VH1-CH1-hinge-CH2-CH3, wherein VH1 is a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-CH3 is a second Fc domain; and c) a common light chain comprising, from N-terminus to C-terminus, VL-CL, wherein VL is a variable light domain and CL is a constant light domain, wherein the first VH domain and the VL domain together form a first ABD, and the second VH domain and the VL domain together form a second ABD, and wherein one of the first and second ABDs binds human CD28 and the other of the first and second ABDs bind human B7H3.

In certain embodiments, the amino acid sequence of the VH1 domain is selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and wherein the amino acid sequence of the VL domain is SEQ ID NO:874.

In some embodiments, the amino acid sequence of the VH2 domain is selected from the group consisting of SEQ ID NO:585, SEQ ID NO:870, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651.

In certain embodiments, the first Fc domain and second Fc domain are each variant Fc domains.

In some embodiments, the first and second Fc domains comprise a set of heterodimerization skew variants selected from the following heterodimerization variants: S364K/

E357Q:L368D/K370S; S364K:L368D/K370S; S364K: L368E/K370S; D401K:T411E/K360E/Q362E; and T366W: T366S/L368A/Y407V, wherein numbering is according to EU numbering. In certain embodiments, the first and second Fc domains comprise heterodimerization skew variants S364K/E357Q:L368D/K370S.

In some embodiments, the first and second Fc domains each comprise one or more ablation variants. In certain embodiments, the one or more ablation variants are E233P/L234V/L235A/G236del/S267K, wherein numbering is according to EU numbering.

In certain embodiments, one of the first or second monomer further comprises a pI variant. In exemplary embodiments, the CH1-hinge-CH2-CH3 of the first monomer comprises pI variants N208D/Q295E/N384D/Q418E/N421D, wherein numbering is according to EU numbering.

In some embodiments, the CH1-hinge-CH2-CH3 of the first monomer comprises amino acid variants L368D/K370S/N208D/Q295E/N384D/Q418E/N421D/E233P/L234V/L235A/G236del/S267K, and the second Fc domain comprises amino acid variants S364K/E357Q/E233P/L234V/L235A/G236del/S267K, wherein numbering is according to EU numbering.

In some embodiments, the first and second variant Fc domains each comprise amino acid variants 428L/434S.

In another aspect, provided herein is a heterodimeric antibody comprising: a) a first monomer comprising from N-terminal to C-terminal, VH1-CH1-first domain linker-scFv-second domain linker-CH2-CH3, wherein VH1 is a first variable heavy domain, scFv is an anti-CD28 scFv, and CH2-CH3 is a first Fc domain; b) a second monomer comprising from N-terminal to C-terminal a VH1-CH1-hinge-CH2-CH3, wherein CH2-CH3 is a second Fc domain; and c) a light chain comprising, from N-terminus to C-terminus, VL1-CL, wherein VL1 is a variable light domain and CL is a constant light domain, wherein each of the VH1 domain and the first VL1 domain together form a first antigen binding domain (ABD) and the scFv comprises a second VH domain (VH2), a scFv linker, and a second VL domain (VL2), and the VH2 and the VL2 form a second ABD, wherein one of the first and second ABDs bind human CD28 and the other of the first and second ABDs bind a tumor target antigen (TTA).

In certain embodiments, the first ABDs bind human CD28 and the second ABD binds a TTA. In some embodiments, the first ABDs bind a TTA and the second ABD binds human CD28.

In some embodiments, the scFv comprises, from N- to C-terminal, VL2-scFv linker-VH2. In some embodiments, the scFv comprises, from N- to C-terminal, VH2-scFv linker-VL2.

In some embodiments, the amino acid sequence of the VH2 is selected from the group consisting of SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651; and wherein the amino acid sequence of the VL2 is selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In certain embodiments, the TTA is human B7H3.

In some embodiments, the first Fc domain and second Fc domain are each variant Fc domains.

In exemplary embodiments, the first and second Fc domains comprise a set of heterodimerization skew variants selected from the following heterodimerization variants: S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering. In some embodiments, the first and second Fc domains comprise heterodimerization skew variants S364K/E357Q:L368D/K370S.

In some embodiments, the first and second Fc domains each comprise one or more ablation variants. In certain embodiments, the one or more ablation variants are E233P/L234V/L235A/G236del/S267K, wherein numbering is according to EU numbering.

In some embodiments, one of the first or second monomer further comprises a pI variant. In exemplary embodiments, the CH1-hinge-CH2-CH3 of the second monomer comprises pI variants N208D/Q295E/N384D/Q418E/N421D, wherein numbering is according to EU numbering.

In exemplary embodiments, the CH1-hinge-CH2-CH3 of the second monomer comprises amino acid variants L368D/K370S/N208D/Q295E/N384D/Q418E/N421D/E233P/L234V/L235A/G236del/S267K, and the first Fc domain comprises amino acid variants S364K/E357Q/E233P/L234V/L235A/G236del/S267K, wherein numbering is according to EU numbering.

In certain embodiments, the first and second variant Fc domains each comprise amino acid variants 428L/434S.

In one aspect, provided herein is a heterodimeric antibody comprising: a) a first monomer comprising: i) a scFv comprising a first variable heavy domain, an scFv linker and a first variable light domain; and ii) a first Fc domain, wherein the scFv is covalently attached to the N-terminus of the first Fc domain using a domain linker; b) a second monomer comprising, from N-terminus to C-terminus, a VH1-CH1-hinge-CH2-CH3, wherein VH is a first variable heavy domain and CH2-CH3 is a second Fc domain; and c) a light chain comprising, from N-terminus to C-terminus, VL1-CL, wherein VL1 is a variable light domain and CL is a constant light domain, wherein the VH1 and the VL1 together form a first ABD and wherein the scFv comprises a second VH domain (VH2), a scFv linker, and a second VL domain (VL2), wherein the VH2 and the VL2 together form a second ABD, and wherein one of the first ABD and second ABD binds CD28 and the other of the first ABD and second ABD binds a TTA.

In some embodiments, the scFv comprises, from N- to C-terminal, VL2-scFv linker-VH2. In certain embodiments, the scFv comprises, from N- to C-terminal, VH2-scFv linker-VL2.

In certain embodiments, the second ABD binds to human CD28 wherein the amino acid sequence of the VH2 is selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651; and wherein the amino acid sequence of the VL2 is selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the first Fc domain and second Fc domain are each variant Fc domains.

In certain embodiments, the first and second Fc domains comprise a set of heterodimerization skew variants selected from the following heterodimerization variants: S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering. In exemplary embodiments, the first and second Fc domains comprise heterodimerization skew variants S364K/E357Q:L368D/K370S.

In certain embodiments, the first and second Fc domains each comprise one or more ablation variants. In some embodiments, the one or more ablation variants are E233P/L234V/L235A/G236del/S267K, wherein numbering is according to EU numbering.

In certain embodiments, one of the first or second monomer further comprises a pI variant. In exemplary embodiments, the CH1-hinge-CH2-CH3 of the second monomer comprises pI variants N208D/Q295E/N384D/Q418E/N421D, wherein numbering is according to EU numbering.

In exemplary embodiments, the CH1-hinge-CH2-CH3 of the second monomer comprises amino acid variants L368D/K370S/N208D/Q295E/N384D/Q418E/N421D/E233P/L234V/L235A/G236del/S267K, and the first Fc domain comprises amino acid variants S364K/E357Q/E233P/L234V/L235A/G236del/S267K, wherein numbering is according to EU numbering.

In some embodiments, the first and second variant Fc domains each comprise amino acid variants 428L/434S.

In another aspect, provided herein is a heterodimeric antibody comprising: a) a first monomer comprising from N-terminal to C-terminal, VH1-CH1-hinge-CH2-CH3-domain linker-scFv, wherein VH1 is a first variable heavy domain, scFv is an anti-CD28 scFv, and CH2-CH3 is a first Fc domain; b) a second monomer comprising from N-terminal to C-terminal a VH1-CH1-hinge-CH2-CH3, wherein CH2-CH3 is a second Fc domain; and c) a light chain comprising, from N-terminus to C-terminus, VL1-CL, wherein VL1 is a variable light domain and CL is a constant light domain, wherein each of the VH1 domain and the first VL1 domain together form a first antigen binding domain (ABD) and the scFv comprises a second VH domain (VH2), a scFv linker, and a second VL domain (VL2), and the VH2 and the VL2 together form a second ABD, wherein one of the first and second ABDs bind human CD28 and the other of the first and second ABDs bind a tumor target antigen (TTA).

In certain embodiments, the first ABD bind human CD28 and the second ABD binds a TTA. In some embodiments, the first ABD bind a TTA and the second ABD binds human CD28.

In certain embodiments, the scFv comprises, from N- to C-terminal, VL2-scFv linker-VH2. In some embodiments, the scFv comprises, from N- to C-terminal, VH2-scFv linker-VL2.

In certain embodiments, the amino acid sequence of the VH2 is selected from the group consisting of SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651; and wherein the amino acid sequence of the VL2 is selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the TTA is human B7H3.

In some embodiments, the first Fc domain and second Fc domain are each variant Fc domains. In some embodiments, the first and second Fc domains comprise a set of heterodimerization skew variants selected from the following heterodimerization variants: S364K/E357Q:L368D/K370S; S364K:L368D/K370S; S364K:L368E/K370S; D401K: T411E/K360E/Q362E; and T366W:T366S/L368A/Y407V, wherein numbering is according to EU numbering. In certain embodiments, the first and second Fc domains comprise heterodimerization skew variants S364K/E357Q:L368D/K370S.

In some embodiments, the first and second Fc domains each comprise one or more ablation variants. In certain embodiments, the one or more ablation variants are E233P/L234V/L235A/G236del/S267K, wherein numbering is according to EU numbering.

In some embodiments, one of the first or second monomer further comprises a pI variant. In exemplary embodiments, the CH1-hinge-CH2-CH3 of the second monomer comprises pI variants N208D/Q295E/N384D/Q418E/N421D, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/S267K, and the first Fc domain comprises amino acid variants S364K/E357Q/E233P/L234V/L235A/G236del/S267K, wherein numbering is according to EU numbering.

In exemplary embodiments, the first and second variant Fc domains each comprise amino acid variants 428L/434S.

In another aspect, provided herein is a nucleic acid composition comprising: a) a first nucleic acid encoding the first monomer of any of the heterodimeric antibodies described herein; b) a second nucleic acid encoding the second monomer of the heterodimeric antibody; and c) a third nucleic acid encoding the light chain of the heterodimeric antibody, respectively. Also provided herein are expression vector compositions that include expression vectors comprising one or more of the first, second and third nucleic acids, host cells that include such expression vector compositions, and methods of making the heterodimeric antibodies described herein.

In another aspect, provided herein is a method of treating cancer in a patient in need thereof, comprising administering to the patient a heterodimeric antibody provided herein.

In another aspect, provided herein is a method of treating cancer in a patient in need thereof, comprising administering to the patient: a) a heterodimeric antibody described herein, wherein the TTA is human B7H3; and b) a bispecific antibody that binds CD3 and B7H3.

In yet another aspect, provided herein is a method of treating cancer in a patient in need thereof, comprising administering to the patient: a) a heterodimeric antibody described herein, wherein the TTA is human B7H3; and b) a checkpoint inhibitor selected from the group consisting of an anti-PD-1 antibody and an anti-PD-L1 antibody.

In yet another aspect, provided herein is a composition comprising an anti-CD28 ABD comprising: a) a variable heavy domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672; and b) variable light domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756. In some embodiments, the composition is an antibody comprising: a) a heavy chain comprising the VH—CH1-hinge-CH2-CH3; and b) a light chain comprising the VL-CL.

In another aspect, provided herein is a composition comprising an anti-B7H3 ABD comprising: a) a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and b) variable light domain having the amino acid sequence selected from the group consisting of SEQ ID NO:874 and SEQ ID NO: 932.

In one aspect, provided herein is composition comprising an anti-B7H3 ABD comprising: a) a variable heavy domain having the amino acid sequence of SEQ ID NO:946; and b) a variable light domain having the amino acid sequence of SEQ ID NO:950.

In another aspect, provided herein is composition comprising an anti-B7H3 ABD comprising: a) a variable heavy domain having the amino acid sequence of SEQ ID NO:956; and b) a variable light domain having the amino acid sequence of SEQ ID NO:960.

In one aspect, provided herein is a composition comprising an anti-B7H3 ABD comprising: a) a variable heavy domain having the amino acid sequence of SEQ ID NO:964; and b) a variable light domain having the amino acid sequence of SEQ ID NO:968.

In another aspect, provided herein is composition comprising an anti-B7H3 ABD comprising: a) a variable heavy domain having the amino acid sequence of SEQ ID NO:972; and b) a variable light domain having the amino acid sequence of SEQ ID NO:976.

In some embodiments, the composition is an antibody comprising: a) a heavy chain comprising the VH linked to —CH1-hinge-CH2-CH3; and b) a light chain comprising the VL linked to —CL.

In another aspect, provided herein is a nucleic acid composition comprising: a) a first nucleic acid encoding the VH of any of the anti-CD28 ABDs or anti-B7H3 ABDs described herein; and b) a second nucleic acid encoding the VL of the anti-CD28 or anti-B7H3 ABD, respectively. Also provided herein are expression vector compositions that include expression vectors comprising one or more of the first, and second nucleic acids, host cells that include such nucleic acid compositions or expression vector compositions, and methods of making the anti-CD28 ABDs or anti-B7H3 ABDs compositions described herein.

In one aspect, provided herein is a composition that includes a CD28 antigen binding domain (ABD). The CD28 ABD includes the variable heavy complementary determining regions 1-3 (vhCDR1-3) and the variable light complementary determining regions (vlCDR1-3) of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1.

In some embodiments, the CD28 ABD includes a variable heavy domain and a variable light domain of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1. In exemplary embodiments, the CD28 antigen binding domain selected from the following CD28 antigen binding domain: CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1.

In another aspect, provided herein is an anti-CD28 antibody that includes a CD28 antigen binding domain (ABD). The CD28 antigen binding domain includes the variable heavy complementary determining regions 1-3 (vhCDR1-3) and the variable light complementary determining regions (vlCDR1-3) of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1. In some embodiments, the CD28 ABD includes a variable heavy domain and a variable light domain of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1.

In some embodiments, the anti-CD28 antibody includes: a) a first monomer that includes a first antigen binding domain and a first constant domain; and b) a second monomer that includes a second antigen binding domain and a second constant domain, wherein either of the first antigen binding domain or second antigen binding domain is the CD28 antigen binding domain.

In some embodiments, the first antigen binding domain and the second antigen binding domain bind different antigens.

In certain embodiments, the CD28 antigen binding domain is an anti-CD28 single chain fragment (scFv). In exemplary embodiments, the scFv includes a charged scFv linker.

In some embodiments, the first and second constant domains each include CH2-CH3. In exemplary embodiments, the first and second constant domains each are a variant constant domain. In certain embodiments, the first and second constant domains include a set of heterodimerization variants selected from the group consisting of S364K/E357Q:L368D/K370S; S364K:L368D/K370S; S364K:L368E/K370S; D401K:T411E/K360E/Q362E; and T366W:T366S/L368A/Y407V. In certain embodiments, the first and second monomers each further include one or more ablation variants. In exemplary embodiments, the ablation variants are E233P/L234V/L235A/G236del/S267K. In some embodiments, at least one of the first or second monomer further include one or more pI variants. In particular embodiments, the pI variants are N208D/Q295E/N384D/Q418E/N421D.

In another aspect, provided herein is a composition that includes a B7H3 antigen binding domain (ABD). The B7H3 binding domain includes the variable heavy complementary determining regions 1-3 (vhCDR1-3) and the variable light complementary determining regions (vlCDR1-3) of any of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the B7H3 ABD includes a variable heavy domain and a variable light domain of any of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the B7H3 ABD is selected from the following B7H3 antigen binding domain: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In yet another aspect, provided herein is an anti-B7H3 antibody that includes an B7H3 antigen binding domain, the B7H3 antigen binding domain includes the variable heavy complementary determining regions 1-3 (vhCDR1-3) and the variable light complementary determining regions (vlCDR1-3) of any of the following B7H3 antigen binding domain: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the anti-B7H3 antibody includes a B7H3 antigen binding domain. The B7H3 antigen binding domain includes a variable heavy domain and a variable light domain of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704. In exemplary embodiments, the B7H3 antigen binding domain selected from any one of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the antibody includes: a) a first monomer that includes a first antigen binding domain and a first constant domain; and b) a second monomer that includes a second antigen binding domain and a second constant domain, wherein either of the first antigen binding domain or second antigen binding domain is the B7H3 antigen binding domain. In certain embodiments, first antigen binding domain and the second antigen binding domain bind different antigens.

In exemplary embodiments, the first antigen binding domain is a B7H3 antigen binding domain and the second antigen binding domain is a CD28 binding domain. In some embodiments, the CD28 binding domain includes the vhCDR1-3, and vlCDR1-3 of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1. In some embodiments, the CD28 binding domain includes the variable heavy domain and variable light domain of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1. In certain embodiments, the CD28 binding domain is an anti-CD28 scFv. In exemplary embodiments, the scFv comprises a charged scFv linker.

In some embodiments, the first and second constant domains each comprise CH2-CH3. In exemplary embodiments, the first and second constant domains each are a variant constant domain.

In particular embodiments, the first and second constant domains include a set of heterodimerization variants selected from S364K/E357Q:L368D/K370S; S364K:L368D/K370S; S364K:L368E/K370S; D401K:T411E/K360E/Q362E; and T366W:T366S/L368A/Y407V. In certain embodiments, the first and second monomers each include one or more ablation variants. In certain embodiments, the ablation variants are E233P/L234V/L235A/G236del/S267K. In some embodiments, at least one of the first or second monomers further include one or more pI variants. In particular embodiments, the pI variants are N208D/Q295E/N384D/Q418E/N421D.

In another aspect, provided herein is an anti-CD28×anti-TAA 1+1 Fab-scFv-Fc heterodimeric antibody. In one embodiment, the heterodimeric antibody includes: a) a first monomer comprising: i) an anti-CD28 scFv comprising a first variable heavy domain, an scFv linker and a first variable light domain; and ii) a first Fc domain, wherein the scFv is covalently attached to the N-terminus of the first Fc domain using a domain linker; b) a second monomer comprising, from N-terminus to C-terminus, a VH2-CH1-hinge-CH2-CH3, wherein VH2 is a second variable heavy domain and CH2-CH3 is a second Fc domain; and c) a third monomer comprising a second variable light domain, wherein the second variable heavy domain and the second variable light domain form a tumor associated antigen (TAA) binding domain.

In some embodiments, the anti-CD28 scFv comprises the vhCDR1-3 and the vlCDR1-3 of any of the following CD28 antigen binding domains: 1A7[CD28]_H1L1, 1A7[CD28]_ H1.14L1, 1A7[CD28]_H1_L1.71, 1A7[CD28]_ H1.1_L1.71, 1A7[CD28]_H1.14_L1.71, CD28.3[CD28]_ H0L0, hCD28.3[CD28]_H1L1, 5.11A1[CD28]_H0L0, TGN1412_H1L1, 341VL34[CD28]_H1L1, 341VL36 [CD28]_H1L1, 281VL4[CD28]_H1L1, HuTN228[CD28]_ H1L1, PV1[CD28]_H0L0, m9.3[CD28]_H0L0, and hu9.3 [CD28]_H1L1.

In certain embodiments, the first variable heavy domain and first variable light domain of the anti-CD28 scFv are the variable heavy domain and variable light domain, respectively, of any of the following CD28 antigen binding domains: 1A7[CD28]_H1L1, 1A7[CD28]_H1.14L1, 1A7 [CD28]_H1_L1.71, 1A7[CD28]_H1.1_L1.71, 1A7[CD28]_ H1.14_L1.71, CD28.3[CD28]_H0L0, hCD28.3[CD28]_ H1L1, 5.11A1[CD28]_H0L0, TGN1412_H1L1, 341VL34 [CD28]_H1L1, 341VL36[CD28]_H1L1, 281VL4[CD28]_ H1L1, HuTN228[CD28]_H1L1, PV1[CD28]_H0L0, m9.3 [CD28]_H0L0, and hu9.3[CD28]_H1L1.

In particular embodiments, the TAA binding domain is a B7H3 binding domain. In some embodiments, the B7H3 binding domain comprises the vhCDR1-3 and vlCDR1-3 of any of the following B7H3 antigen binding domains: 2E4A3.189[B7H3]_H1L1, 2E4A3.189[B7H3]_H1/1A7 [CD28]_L1, 2E4A3.189[B7H3]_H1.22L1, 2E4A3.189 [B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the second variable heavy domain and the second variable light domain are the variable heavy domain and variable light domain, respectively, of any of the following B7H3 antigen binding domains: 2E4A3.189[B7H3]_H1L1, 2E4A3.189[B7H3]_H1/1A7 [CD28]_L1, 2E4A3.189[B7H3]_H1.22L1, 2E4A3.189 [B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the anti-CD28 scFv is oriented, from N-terminus to C-terminus, first variable light domain-scFv linker-first variable heavy domain. In other embodiments, the anti-CD28 scFv is oriented, from N-terminus to C-terminus, first variable heavy domain-scFv linker-first variable light domain. In many embodiments, the scFv linker is a charged scFv linker.

In certain embodiments, first and second Fc domains are variant Fc domains. In some embodiments, the first and second Fc domains comprise a set of heterodimerization skew variants selected from the group consisting of S364K/ E357Q:L368D/K370S; S364K:L368D/K370S; S364K: L368E/K370S; D401K:T411E/K360E/Q362E; and T366W: T366S/L368A/Y407V, wherein numbering is according to EU numbering. In exemplary embodiments, the first and second Fc domains comprise heterodimerization skew variants S364K/E357Q:L368D/K370S.

In certain embodiments, first and second Fc domains each comprise one or more ablation variants. In exemplary embodiments, the one or more ablation variants are E233P/ L234V/L235A/G236del/S267K, wherein numbering is according to EU numbering.

In some embodiments, one of the first or second monomers comprise one or more pI variants. In exemplary embodiments, the CH1-hinge-CH2-CH3 of the second monomer comprises pI variants N208D/Q295E/N384D/ Q418E/N421D, wherein numbering is according to EU numbering.

In exemplary embodiments, the first Fc domain comprises amino acid variants S364K/E357Q/E233P/L234V/L235A/ G236del/S267K; the CH1-hinge-CH2-CH3 of the second monomer comprises amino acid variants L368D/K370S/ N208D/Q295E/N384D/Q418E/N421D/E233P/L234V/ L235A/G236del/S267K, and wherein numbering is according to EU numbering.

In certain embodiments, the scFv linker is a charged scFv linker having the amino acid sequence (GKPGS)$_4$.

In particular embodiments, the first and second Fc domains each further comprise amino acid variants 428/ 434S.

In some embodiments, the anti-CD28×anti-TAA 1+1 Fab-scFv-Fc heterodimeric antibody includes: a) a first monomer comprising, from N-terminus to C-terminus, an anti-CD28 scFv-linker-CH2-CH3, wherein CH2-CH3 is a first Fc domain; b) a second monomer comprising, from N-terminus to C-terminus, a VH—CH1-hinge-CH2-CH3, wherein CH2-CH3 is a second variant Fc domain; and c) a third monomer comprising VL-CL; wherein the first variant Fc domain comprises amino acid variants S364K/E357Q, wherein the second variant Fc domain comprises amino acid variants L368D/K370S, wherein the first and second variant Fc domains each comprises amino acid variants E233P/L234V/ L235A/G236del/S267K, wherein the CH1-hinge-CH2-CH3 of the second monomer comprises amino acid variants N208D/Q295E/N384D/Q418E/N421D, wherein the VH and VL form a tumor associated antigen (TAA) binding domain, and wherein the anti-CD28 scFv comprises the variable heavy domain and the variable light domain of one of the following CD28 antigen binding domains: 1A7[CD28]_ H1L1, 1A7[CD28]_H1.14L1, 1A7[CD28]_H1_L1.71, 1A7 [CD28]_H1.1_L1.71, 1A7[CD28]_H1.14_L1.71, CD28.3 [CD28]_H0L0, hCD28.3[CD28]_H1L1, 5.11A1[CD28]_ H0L0, TGN1412_H1L1, 341VL34[CD28]_H1L1, 341VL36[CD28]_H1L1, 281VL4[CD28]_H1L1, HuTN228 [CD28]_H1L1, PV1[CD28]_H0L0, m9.3[CD28]_H0L0, and hu9.3[CD28]_H1L1, and wherein numbering is according to EU numbering.

In certain embodiments, the TAA binding domain is a B7H3 binding domain. In some embodiments, VH and VL are the variable heavy domain and variable light domain, respectively, of any of the following B7H3 antigen binding domains: 2E4A3.189[B7H3]_H1L1, 2E4A3.189[B7H3]_ H1/1A7[CD28]_L1, 2E4A3.189[B7H3]_H1.22L1, 2E4A3.189[B7H3]_H1.22/1A7[CD28]_L1, 6A1[B7H3]_ H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the scFv comprises a charged scFv linker having the amino acid sequence (GKPGS)$_4$. In some embodiments, the first and second variant Fc domains each further comprise amino acid variants 428/434S, wherein numbering is according to EU numbering.

In another aspect, provided herein are anti-CD28×anti-TAA 2+1 Fab$_2$-scFv-Fc antibodies that include: a) a first monomer comprising, from N-terminus to C-terminus, a VH1-CH1-linker 1-anti-CD28 scFv-linker 2-CH2-CH3, wherein VH1 is a first variable heavy domain, linker 1 and linker 2 are a first domain linker and second domain linker, respectively, and CH2-CH3 is a first Fc domain; b) a second monomer comprising, from N-terminus to C-terminus, a VH2-CH1-hinge-CH2-CH3, wherein VH2 is a second variable heavy domain and CH2-CH3 is a second Fc domain; and c) a common light chain comprising a variable light domain; wherein the first variable heavy domain and the variable light domain form a first tumor associated antigen (TAA) binding domain, and the second variable heavy domain and the variable light domain form a second TAA binding domain.

In exemplary embodiments, the first TAA binding domain and second TAA binding domain are each B7H3 binding domains. In exemplary embodiments, the first and second B7H3 binding domains each comprise the vhCDR1-3 and vlCDR1-3 of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704. In some embodiments, the first and second variable heavy domain each comprise a variable heavy domain of a B7H3 binding domain, and the variable light domain comprises a variable light domain of the B7H3 binding domain, wherein the B7H3 binding domain is any of the following B7H3 antigen binding domains: 2E4A3.189 [B7H3]_H1L1, 2E4A3.189[B7H3]_H1/1A7[CD28]_L1, 2E4A3.189[B7H3]_H1.22L1, 2E4A3.189[B7H3]_H1.22/ 1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In several embodiments of the anti-CD28×anti-TAA 2+1 Fab$_2$-scFv-Fc antibody, the anti-CD28 scFv comprises an scFv variable heavy domain, an scFv variable light domain and an scFv linker that connects the scFv variable heavy domain and the scFv variable light domain. In certain embodiments, the anti-CD28 scFv comprises the vhCDR1-3 and the vlCDR1-3 of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1. In certain embodiments, the scFv variable heavy domain and the scFv variable light domain of the anti-CD28 scFv comprises the variable heavy domain and variable light domain, respectively, of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In some embodiments, the scFv variable heavy domain is attached to the C-terminus of the CH1 of the first monomer using the first domain linker and the scFv variable light domain is covalently attached to the N-terminus of the first Fc domain using the second domain linker. In other embodiments, the scFv variable light domain is attached to the C-terminus of the CH1 of the first monomer using the first domain linker and the scFv variable heavy domain is covalently attached to the N-terminus of the first Fc domain using the second domain linker. In some embodiments, the scFv linker is a charged scFv linker.

In certain embodiments, the first and second Fc domains are variant constant domains. In the first and second Fc domains comprise a set of heterodimerization variants selected from the following heterodimerization skew variants: S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering. In some embodiments, the first and second Fc domains include heterodimerization skew variants S364K/E357Q:L368D/K370S.

In some embodiments, the first and second Fc domains each include one or more ablation variants. In exemplary embodiments, the one or more ablation variants are E233P/L234V/L235A/G236del/S267K, wherein numbering is according to EU numbering.

In some embodiments, one of the first or second monomer comprises one or more pI variants. In particular embodiments, the CH1-hinge-CH2-CH3 of the second monomer comprises pI variants N208D/Q295E/N384D/Q418E/N421D, wherein numbering is according to EU numbering.

In exemplary embodiments, the first Fc domain of the first monomer comprises amino acid variants S364K/E357Q/E233P/L234V/L235A/G236del/S267K, the CH1-hinge-CH2-CH3 of the second monomer comprises amino acid variants N208D/E233P/L234V/L235A/G236del/S267K/Q295E/L368D/K370S/N384D/Q418E/N421D, and wherein numbering is according to EU numbering.

In some embodiments, the anti-CD28 scFv comprises a charged scFv linker having the amino acid sequence (GKPGS)$_4$. In certain embodiments, the first and second variant Fc domains each further comprise amino acid variants 428/434S, wherein numbering is according to EU numbering.

In some embodiments, the anti-CD28×anti-TAA 2+1 Fab$_2$-scFv-Fc antibodies include: a) a first monomer comprising from N-terminal to C-terminal, a VH1-CH1-linker 1-anti-CD28 scFv-linker 2-CH2-CH3, wherein CH2-CH3 is a first variant Fc domain; b) a second monomer comprising from N-terminal to C-terminal a VH1-CH1-hinge-CH2-

CH3, wherein CH2-CH3 is a second variant Fc domain; and c) a common light chain comprising VL-CL; wherein the first variant Fc domain comprises amino acid variants S364K/E357Q, wherein the second variant Fc domain comprises amino acid variants L368D/K370S, wherein the first and second variant Fc domains each comprises amino acid variants E233P/L234V/L235A/G236del/S267K, wherein the CH1-hinge-CH2-CH3 of the second monomer comprises amino acid variants N208D/Q295E/N384D/Q418E/N421D, wherein the VH1 and VL each form a tumor associated antigen (TAA) binding domain, wherein the anti-CD28 scFv comprises the variable heavy domain and the variable light domain of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1, and wherein numbering is according to EU numbering.

In some embodiments, the VH1 and VL form a B7H3 binding domain. In exemplary embodiments, the VH1 and VL are the variable heavy domain and variable light domain of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the scFv comprises a charged scFv linker having the amino acid sequence (GKPGS)$_4$. In certain embodiments, the first and second variant Fc domains each further comprise amino acid variants 428/434S.

In another aspect, provided herein are anti-CD28×anti-TAA 1+1 CLC heterodimeric antibodies that include: a) a first monomer comprising, from N-terminus to C-terminus, a VH1-CH1-hinge-CH2-CH3, wherein VH1 is a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-C3 is a second Fc domain; and c) a common light chain comprising, from N-terminus to C-terminus, VL-CL, wherein VL is a variable light domain and CL is a constant light domain, wherein the first variable heavy domain and the variable light domain form a first antigen binding domain, and the second variable heavy domain and the variable light domain form a second antigen binding domain.

In some embodiments, the first Fc domain and second Fc domain are each variant Fc domains. In certain embodiments, the first and second Fc domains comprise a set of heterodimerization skew variants selected from the following heterodimerization skew variants: S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering.

In exemplary embodiments, the first and second Fc domains comprise heterodimerization skew variants S364K/E357Q:L368D/K370S.

In certain embodiments, the first and second Fc domains each comprise one or more ablation variants. In exemplary embodiments, the one or more ablation variants are E233P/L234V/L235A/G236del/S267K, wherein numbering is according to EU numbering.

In some embodiments, one of the first or second monomer further comprises a pI variant. In particular embodiments, the CH1-hinge-CH2-CH3 of the first monomer comprises pI variants N208D/Q295E/N384D/Q418E/N421D, wherein numbering is according to EU numbering.

In certain embodiments, the CH1-hinge-CH2-CH3 of the first monomer comprises amino acid variants L368D/K370S/N208D/Q295E/N384D/Q418E/N421D/E233P/L234V/L235A/G236del/S267K, the second Fc domain comprises amino acid variants S364K/E357Q/E233P/L234V/L235A/G236del/S267K, and wherein numbering is according to EU numbering.

In some embodiments, the first and second variant Fc domains each comprise amino acid variants 428/434S.

In certain embodiments, the first antigen binding domain or the second binding domain binds CD28 and the other antigen binding domain binds a tumor associated antigen (TAA).

In certain embodiments, the second antigen binding domain binds CD28 and VH2 and VL comprises the variable heavy domain and variable light domain, respectively, of any one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In some embodiments, the first antigen binding domain binds the TTA. IN exemplary embodiments, the TAA is B7H3. In exemplary embodiments, the VH1 and VL comprises the variable heavy domain and variable light domain, respectively, of any one of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the first antigen binding domain binds B7H3 and the second antigen binding domain binds CD28, VH1 is variable heavy domain 2E4A3.189[B7H3]_H1.22, VH2 is variable heavy domain A7[CD28]_H1.14, and VL is variable light domain 1A7[CD28]_L1.

In one aspect, provided herein are anti-CD28×anti-TAA 2+1 CLC heterodimeric antibodies that include: a) a first monomer comprising, from N-terminus to C-terminus, a VH1-CH1-linker-VH1-CH1-hinge-CH2-CH3, wherein the VH1s are each a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-

C3 is a second Fc domain; and c) a common light chain comprising, from N-terminus to C-terminus, VL-CL, wherein VL is a variable light domain and CL is a constant light domain, wherein the first variable heavy domains and the variable light domain each form a first antigen binding domain, and the second variable heavy domain and the variable light domain form a second antigen binding domain.

In some embodiments, the first Fc domain and second Fc domain are each variant Fc domains. In some embodiments, the first and second Fc domains comprise a set of heterodimerization skew variants selected from the following heterodimerization variants: S364K/E357Q:L368D/K370S; S364K:L368D/K370S; S364K:L368E/K370S; D401K: T411E/K360E/Q362E; and T366W:T366S/L368A/Y407V, wherein numbering is according to EU numbering. In certain embodiments, the first and second Fc domains comprise heterodimerization skew variants S364K/E357Q:L368D/K370S.

In several embodiments, the first and second Fc domains each comprise one or more ablation variants. In exemplary embodiments, the one or more ablation variants are E233P/L234V/L235A/G236del/S267K, wherein numbering is according to EU numbering.

In particular embodiments, the one of the first or second monomer further comprises a pI variant. In exemplary embodiments, the CH1-hinge-CH2-CH3 of the first monomer comprises pI variants N208D/Q295E/N384D/Q418E/N421D, wherein numbering is according to EU numbering.

In some embodiments of the anti-CD28×anti-TAA 2+1 CLC heterodimeric antibodies, the CH1-hinge-CH2-CH3 of the first monomer comprises amino acid variants L368D/K370S/N208D/Q295E/N384D/Q418E/N421D/E233P/L234V/L235A/G236del/S267K, the second Fc domain comprises amino acid variants S364K/E357Q/E233P/L234V/L235A/G236del/S267K, and wherein numbering is according to EU numbering.

In some embodiments, the first and second variant Fc domains each comprise amino acid variants 428/434S.

In certain embodiments, the first antigen binding domains binds CD28 and the second antigen binding domain binds a tumor associated antigen (TAA). In exemplary embodiments, VH1 and VL comprises the variable heavy domain and variable light domain, respectively, of any one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In some embodiments, the TAA is B7H3. In exemplary embodiments, VH2 and VL comprises the variable heavy domain and variable light domain, respectively, of any one of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, VH1 is variable heavy domain 1A7[CD28]_H1.14, VH2 is variable heavy domain 2E4A3.189[B7H3]_H1.22, and VL is variable light domain 1A7[CD28]_L1.

In another aspect, provided herein is a heterodimeric antibody selected from the following heterodimeric antibodies: XENP34730, XENP34389, XENP34728, XENP34717 and XENP34339.

Also provided herein are nucleic acid compositions encoding the compositions and antibodies provided herein, expression vectors that include such nucleic acids, and host cells that include the expression vectors.

In another aspect, provided herein are methods of treating a cancer comprising administering to a patient in need thereof an antibody provided herein (e.g., an anti-CD28× anti-TAA antibody). In some embodiments, the patient is also administered a cancer therapeutic. In particular embodiments, the therapeutic is a checkpoint inhibitor (e.g., an anti-PD1 antibody) or an anti-CD3×anti-TAA bispecific antibody.

BRIEF DESCRIPTION OF THE DRAWINGS

FIG. 1 depicts the sequences for human, mouse, and cynomolgus CD28. Such CD28 are useful for the development of cross-reactive CD28 antigen binding domains for ease of clinical development.

FIGS. 2A and 2B depict the sequences for human, mouse, and cynomolgus B7H3. Such B7H3 are useful for the development of cross-reactive B7H3 antigen binding domains for ease of clinical development.

FIG. 3A-3F depict useful pairs of heterodimerization variant sets (including skew and pI variants). In FIG. 3F, there are variants for which there are no corresponding "monomer 2" variants. Such variants are pI variants that can be used alone on either monomer of a αB7H3ΔαCD28 bsAb, or included, for example, on the non-scFv side of a format that utilizes an scFv as a component and an appropriate charged scFv linker can be used on the second monomer that utilizes an scFv as the CD28 binding domain. Suitable charged linkers are shown in FIG. 6.

FIG. 4 depicts a list of isosteric variant antibody constant regions and their respective substitutions. pI_(−) indicates lower pI variants, while pI_(+) indicates higher pI variants. These variants can be optionally and independently combined with other variants, including heterodimerization variants, outlined herein.

FIG. 5 depict useful ablation variants that ablate FcγR binding (also referred to as "knockouts" or "KO" variants). In some embodiments, such ablation variants are included in the Fc domain of both monomers of the subject antibody described herein. In other embodiments, the ablation variants are only included on only one variant Fc domain.

FIG. 6 depicts a number of charged scFv linkers that find use in increasing or decreasing the pI of the subject heterodimeric αB7H3ΔαCD28 bsAbs that utilize one or more scFv as a component, as described herein. The (+H) positive linker finds particular use herein, particularly with anti-CD28 $V_L$ and $V_H$ sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs. Such charged scFv linkers can be used in any of the subject antibody formats disclosed herein that include scFvs (e.g., 1+1 Fab-scFv-Fc and 2+1 Fab$_2$-scFv-Fc formats).

FIG. 7 depicts a number of exemplary domain linkers. In some embodiments, these linkers find use linking a single-chain Fv to an Fc chain. In some embodiments, these linkers may be combined in any orientation. For example, a GGGGS linker may be combined with a "lower half hinge" linker at the N-terminus or at the C-terminus. In some embodiments, two or more of the domain linkers depicted in FIG. 7 can be combined to form longer domain linkers for use in the heterodimeric antibodies described herein.

FIG. 8 shows a particularly useful embodiment of the heterodimeric Fc domains (i.e. CH2-CH3 in this embodiment) of the αB7H3ΔαCD28 bsAbs of the invention.

FIG. 9 depicts various heterodimeric skewing variant amino acid substitutions that can be used with the heterodimeric antibodies described herein.

FIGS. 10A-10C show the sequences of several useful heterodimeric αB7-H3×αCD28 bsAb backbones based on human IgG1, without the cytokine sequences. Heterodimeric Fc backbone 1 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants on both chains. Heterodimeric Fc backbone 2 is based on human IgG1 (356E/358M allotype), and includes the L368D/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants on both chains. Heterodimeric Fc backbone 3 is based on human IgG1 (356E/358M allotype), and includes the L368E/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants on both chains. Heterodimeric Fc backbone 4 is based on human IgG1 (356E/358M allotype), and includes the K360E/Q362E/T411E skew variants and the Q295E/N384D/Q418E/N421D pI variants on a first heterodimeric Fc chain, the D401K skew variant on a second heterodimeric Fc chain, and the E233P/L234V/L235A/G236del/S267K ablation variants on both chains. Heterodimeric Fc backbone 5 is based on human IgG1 (356D/358L allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants on both chains. Heterodimeric Fc backbone 6 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and N297A variant that removes glycosylation on both chains. Heterodimeric Fc backbone 7 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and N297S variant that removes glycosylation on both chains. Heterodimeric Fc backbone 8 is based on human IgG4, and includes the L368D/K370S skew variants and the Q295E/N384D/ Q418E/N421D pI variants on a first heterodimeric Fc chain, the S364K/E357Q skew variants on a second heterodimeric Fc chain, and the S228P (according to EU numbering, S241P in Kabat) variant that ablates Fab arm exchange (as is known in the art) on both chains. Heterodimeric Fc backbone 9 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain. Heterodimeric Fc backbone 10 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain, and the S267K ablation variant on both chains. Heterodimeric Fc backbone 11 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and M428L/N434S Xtend variants on both chains. Heterodimeric Fc backbone 12 is based on human IgG1 (356E/358M allotype), and includes the L368D/K370S skew variants on a first heterodimeric Fc chain, the S364K/E357Q skew variants and P217R/P229R/N276K pI variants on a second heterodimeric Fc chain, and the E233P/L234V/L235A/G236del/S267K ablation variants on both chains.

Figure 25:
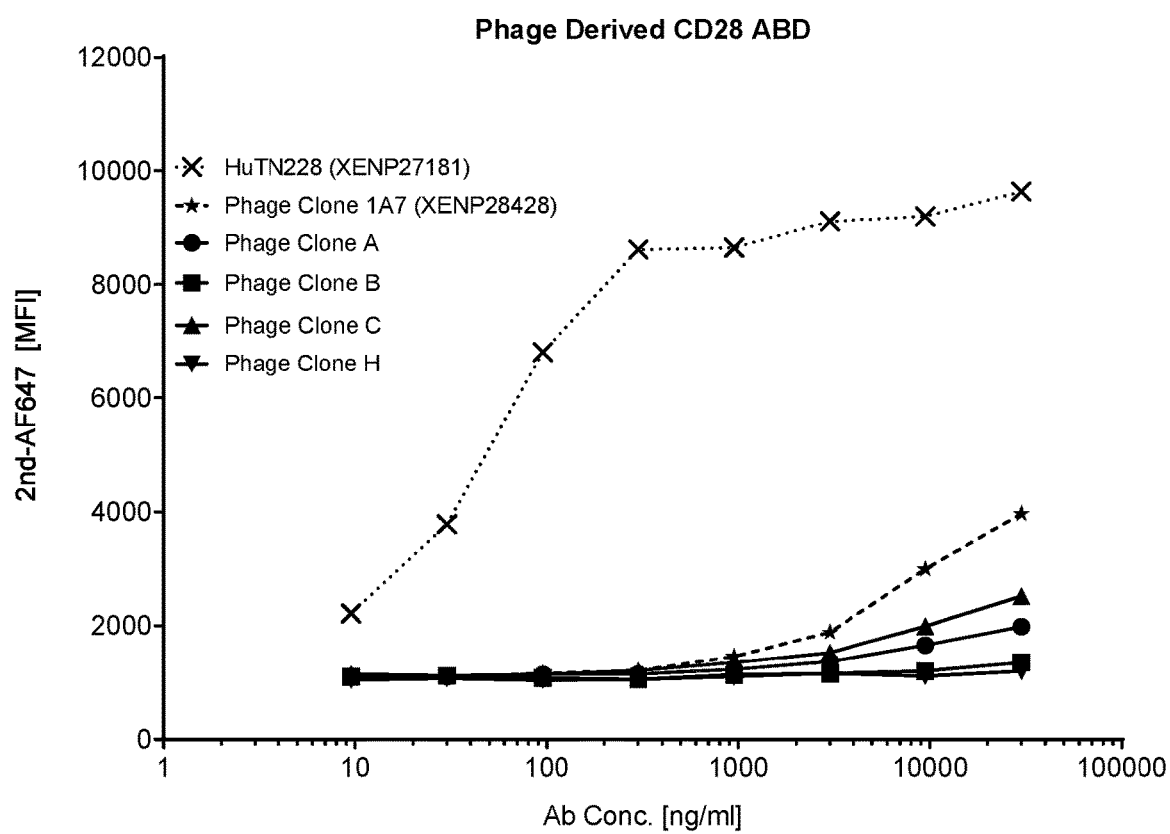

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition or as an alternative to the skew, pI and ablation variants contained within the backbones of this Figure. Additionally, the backbones depicted herein may include deletion of the C-terminal glycine (K446_) and/or lysine (K447_). The C-terminal glycine and/or lysine deletion may be intentionally engineered to reduce heterogeneity or in the context of certain bispecific formats, such as the mAb-scFv format. Additionally, C-terminal glycine and/or lysine deletion may occur naturally for example during production and storage.

FIG. 11 depicts illustrative sequences of heterodimeric B7H3×CD28 bsAb backbone for use in the 2+1 mAb-scFv format. The format depicted here is based on heterodimeric Fc backbone 1 as depicted in Figure X, except further including G446_on monomer 1 (−) and G446_/K447_on monomer 2 (+). It should be noted that any of the additional backbones depicted in Figure X may be adapted for use in the 2+1 mAb-scFv format with or without including K447_on one or both chains. It should be noted that these sequences may further include the M428L/N434S variants.

FIG. 12 depicts sequences for "CH1+ hinge" that find use in embodiments of αB7H3ΔαCD28 bsAbs that utilize a Fab a binding domain. The "CH1+ hinge" sequences find use linking the variable heavy domain (V$_H$) to the Fc backbones (as depicted in FIG. 39). For particular embodiments wherein the Fab is on the (+) side, the "CH1(+)+ hinge" sequences may find use. For particular embodiments wherein the Fab is on the (−) side, the "CH1(−)+ hinge" sequences may find use.

FIG. 13 depicts sequences for "CH1+ half hinge" domain linker that find use in embodiments of αB7H3ΔαCD28 bsAbs in the 2+1 Fab₂-scFv-Fc format or 2+1 CLC format. In the 2+1 Fab₂-scFv-Fc format, the "CH1+ half hinge" sequences find use linking the variable heavy domain ($V_H$) to the scFv domain on the Fab-scFv-Fc side of the bispecific antibody. In the 2+1 CLC format, the "CH1+ half hinge" sequences find use linking the first variable heavy domain ($V_H$) to the second $V_H$ domain on the Fab-Fab-Fc side of the bispecific antibody. It should be noted that other linkers may be used in place of the "CH1+ half hinge". It should also be noted that although the sequences here are based on the IgG1 sequence, equivalents can be constructed based on the IgG2 or IgG4 sequences.

FIG. 14 depicts sequences for "CH1" that find use in embodiments of αB7H3ΔαCD28 bsAbs.

FIG. 15 depicts sequences for "hinge" that find use in embodiments of αB7H3ΔαCD28 bsAbs.

FIG. 16 depicts the constant domain of the cognate light chains which find use in the subject αB7H3ΔαCD28 bsAbs that utilize a Fab binding domain.

FIG. 17 depicts the sequences for XENP16432, an anti-PD-1 mAb based on nivolumab and IgG1 backbone with E233P/L234V/L235A/G236del/S267K ablation variant. CDRs are underlined and slashes indicate the border(s) between the variable regions and constant domain.

FIG. 18 depicts the variable heavy and variable light chain sequences for 1A7, an exemplary phage-derived CD28 binding domain, as well as the sequences for XENP28428, an anti-CD28 mAb based on 1A7 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 19 depicts the sequence for illustrative affinity-optimized 1A7 VH variants. It should be noted that the VH depicted herein can be paired with any of the other variable light domains depicted herein.

FIG. 20 depicts the sequence for illustrative affinity-optimized 1A7-derived variable light domains. It should be noted that this VL can be paired with any of the other variable heavy domains depicted herein.

FIGS. 21A and 21B depict the sequence for illustrative affinity-optimized 1A7 VH/VH pairs. It should be noted that these pairs may be formatted as Fabs or as scFvs.

FIG. 22 depicts illustrative affinity-engineered 1A7 VH/VL pairs and their binding affinities in the context of A) scFvs (in the context of 1+1 Fab-scFv-Fc bsAb format) and B) Fab (in the context of 2+1 CLC bsAb format).

FIG. 23 depicts the sequences for XENP27181, a bivalent anti-CD28 mAb based on HuTN228 binding domain and IgG1 backbone with E233P/L234V/L235A/G236del/S267K ablation variant; and XENP27656, a monovalent anti-CD28 mAb based on HuTN228 binding domain (formatted as an scFv) and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 24 depicts $K_{Dapp}$ ($K_D$ apparent due to bivalent binding) of various CD28 binding phage clones (formatted as bivalent mAbs) for human CD28 as determined by Octet. First 60 seconds of dissociation was used for data fit.

FIG. 25 depicts binding of illustrative bivalent anti-CD28 mAbs based on phage-derived clones on human PBMCs. The data show that the phage campaign generated CD28 binding domains having weaker maximum binding than prior art HuTN228 (which is related to the humanized CD28 binding domains described in Example 1A).

FIG. 26 depicts the variable heavy and variable light chain sequences for 2E4A3.189, an exemplary phage-derived B7H3 binding domain, as well as the sequences for XENP32637, an anti-B7H3 mAb based on 2E4A3.189 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 27 depicts the sequence for affinity-optimized variable heavy 2E4A3.189_H1.22. It should be noted that this VH can be paired with any of the other variable light domains (VL) depicted herein.

FIG. 28 depicts the variable heavy and variable light chain sequences for humanized 6A1, an exemplary rat hybridoma-derived B7H3 binding domain, as well as the sequences for XENP33383, an anti-B7H3 mAb based on 6A1 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 29 depicts the variable heavy and variable light chain sequences for humanized 3C4, an exemplary rat hybridoma-derived B7H3 binding domain. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 30 depicts the variable heavy and variable light chain sequences for humanized 4F12, an exemplary rabbit hybridoma-derived B7H3 binding domain. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 31 depicts the variable heavy and variable light chain sequences for humanized 38E2, an exemplary rabbit hybridoma-derived B7H3 binding domain. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 32 depicts the monovalent binding affinities ($K_D$) of various B7H3 binding domains in the context of 1+1 bispecific formats. It should be noted that the 2E4A3_H1.22_1A7_L1 and 2E4A3_H1.3_1A7_L1 utilize the $V_L$ of anti-CD28 clone 1A7.

Figure 33A:
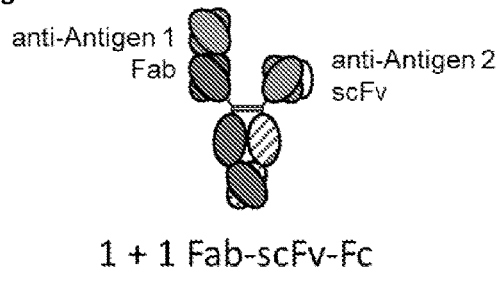
Figure 33B:
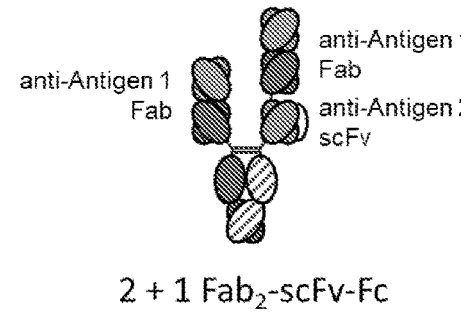
Figure 33C:
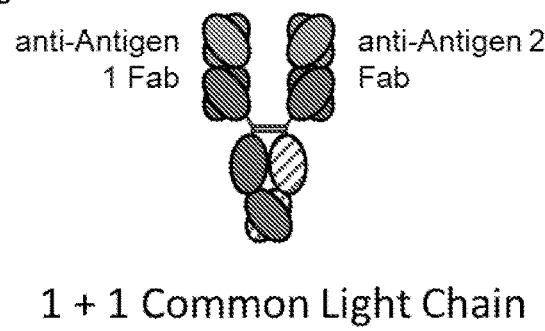
Figure 33D:
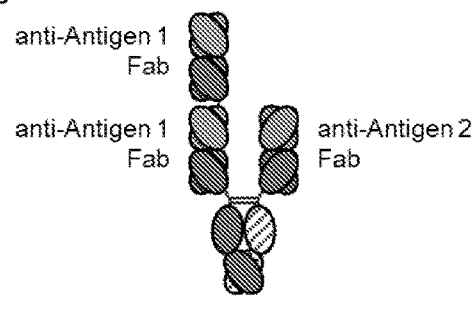

FIGS. 33A-33E depict exemplary formats of the present invention. FIG. 33A depicts the "1+1 Fab-scFv-Fc" format, with a first Fab arm binding a first antigen and a second scFv arm binding second antigen. The 1+1 Fab-scFv-Fc format comprises a first monomer comprising a first heavy chain variable region (VH1) covalently attached to the N-terminus of a first heterodimeric Fc backbone (optionally via a linker), a second monomer comprising a single-chain Fv covalently attached to the N-terminus of a second corresponding heterodimeric Fc backbone (optionally via a linker), and a third monomer comprising a light chain variable region covalently to a light chain constant domain, wherein the light chain variable region is complementary to the VH1. FIG. 33B depicts the "2+1 Fab₂-scFv-Fc" format, with a first Fab arm and a second Fab-scFv arm, wherein the Fab binds a first antigen and the scFv binds second antigen. The 2+1 Fab₂-scFv-Fc format comprises a first monomer comprising a first heavy chain variable region (VH1) covalently attached to the N-terminus of a first heterodimeric Fc backbone (optionally via a linker), a second monomer comprising the VH1 covalently attached (optionally via a linker) to a single-chain Fv covalently attached (optionally via a linker) to the N-terminus of a second corresponding heterodimeric Fc backbone, and a third monomer comprising a light chain variable region covalently to a light chain constant domain, wherein the light chain variable region is complementary to the VH1. FIG. 33C depicts the "1+1 Common Light Chain" or "1+1 CLC" format, with a first Fc comprising a first Fab arm binding a first antigen and a second Fc comprising a second Fab arm binding second antigen. The 1+1 CLC format comprises a first monomer comprising VH1-CH1-hinge-CH2-CH3, a second monomer comprising VH2-CH1-hinge-CH2-CH3, and a third monomer comprising VL-CL. The VL pairs with the VH1 to form a binding domain with a first antigen binding specificity; and the VL pairs with the VH2 to form a binding domain with a second antigen binding specificity. FIG. 33D depicts the "2+1 Common Light Chain" or "2+1 CLC" format, with a first Fc comprising 2 Fab arms each binding a first antigen and a second Fc comprising 1 Fab arm binding a second antigen. The 2+1 CLC format comprises a first monomer comprising VH1-CH1-hinge-VH1-CH1-hinge-CH2-CH3, a second monomer comprising VH2-CH1-hinge-CH2-CH3, and a third monomer comprising VL-CL. The VL pairs with the first and second VH1 to form binding domains with a first antigen binding specificity; and the VL pairs with the VH2 to form a binding domain with a second antigen binding specificity.

Figure 33E:
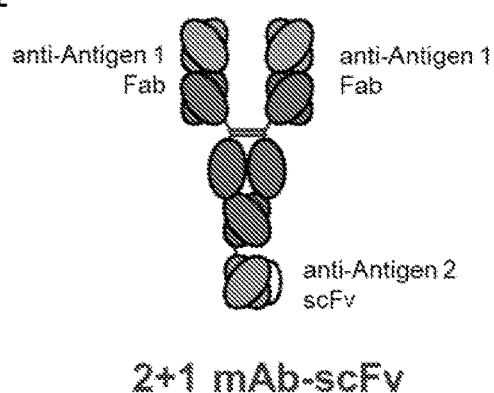

FIG. 33E depicts the "2+1 mAb-scFv" format, with a first Fc comprising an N-terminal Fab arm binding a first antigen and a second Fc comprising an N-terminal Fab arm binding the first antigen and a C-terminal scFv binding a second antigen. The 2+1 mAb-scFv format comprises a first monomer comprising VH1-CH1-hinge-CH2-CH3, a second monomer comprising VH1-CH1-hinge-CH2-CH3-scFv, and a third monomer comprising VL-CL. The VL pairs with the first and second VH1 to form binding domains with binding specificity for the first antigen.

Figure 34A:
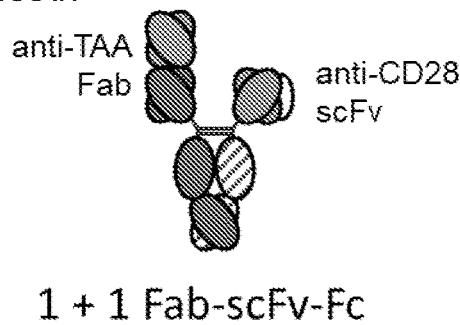

FIGS. 34A-34E depict exemplary formats of the present invention as utilized in CD28 bispecific antibodies. FIG. 34A depicts the "1+1 Fab-scFv-Fc" format, with a first Fab arm binding a tumor-associated antigen and a second scFv arm binding CD28. The 1+1 Fab-scFv-Fc format comprises a first monomer comprising a first heavy chain variable region (VH1) covalently attached to the N-terminus of a first heterodimeric Fc backbone (optionally via a linker), a second monomer comprising a single-chain Fv covalently attached to the N-terminus of a second corresponding heterodimeric Fc backbone (optionally via a linker), and a third monomer comprising a light chain variable region covalently to a light chain constant domain, wherein the light chain variable region is complementary to the VH1.

Figure 34B:
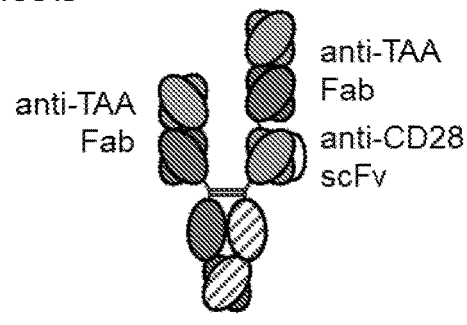
Figure 34C:
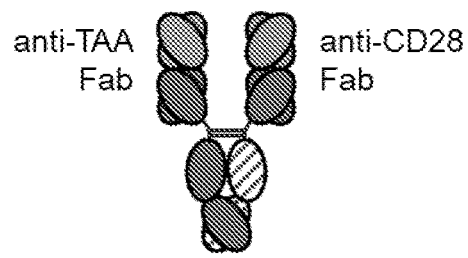
Figure 34D:
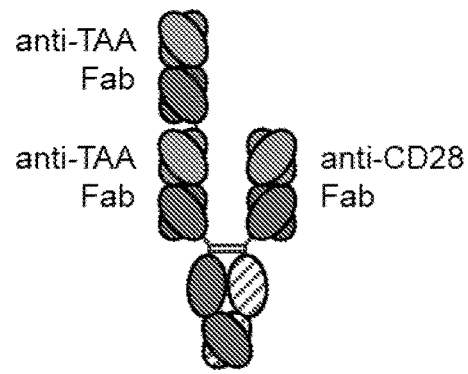

FIG. 34B depicts the "2+1 Fab₂-scFv-Fc" format, with a first Fab arm and a second Fab-scFv arm, wherein the Fab binds a tumor-associated antigen and the scFv binds CD28. The 2+1 Fab₂-scFv-Fc format comprises a first monomer comprising a first heavy chain variable region (VH1) covalently attached to the N-terminus of a first heterodimeric Fc backbone (optionally via a linker), a second monomer comprising the VH1 covalently attached (optionally via a linker) to a single-chain Fv covalently attached (optionally via a linker) to the N-terminus of a second corresponding heterodimeric Fc backbone, and a third monomer comprising a light chain variable region covalently to a light chain constant domain, wherein the light chain variable region is complementary to the VH1. FIG. 34C depicts the "1+1 Common Light Chain" or "1+1 CLC" format, with a first Fc comprising a first Fab arm binding a tumor-associated antigen and a second Fc comprising a second Fab arm binding CD28. The 1+1 CLC format comprises a first monomer comprising VH1-CH1-hinge-CH2-CH3, a second monomer comprising VH2-CH1-hinge-CH2-CH3, and a third monomer comprising VL-CL. The VL pairs with the VH1 to form a binding domain with a first antigen binding specificity; and the $V_L$ pairs with the VH2 to form a binding domain with a second antigen binding specificity. FIG. 34D depicts the "2+1 Common Light Chain" or "2+1 CLC" format, with a first Fc comprising 2 Fab arms each binding a tumor-associated antigen and a second Fc comprising 1 Fab arm binding CD28. The 2+1 CLC format comprises a first monomer comprising VH1-CH1-hinge-VH1-CH1-hinge-CH2-CH3, a second monomer comprising VH2-CH1-hinge-CH2-CH3, and a third monomer comprising VL-CL.

Figure 34E:
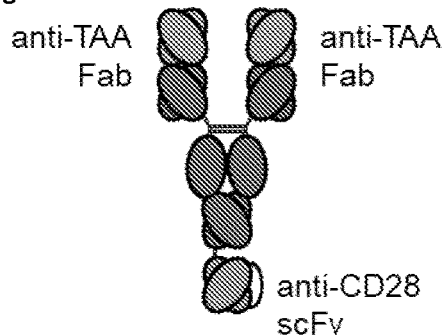

The VL pairs with the first and second VH1 to form binding domains with a first antigen binding specificity; and the VL pairs with the VH2 to form a binding domain with a second antigen binding specificity. FIG. 34E depicts the "2+1 mAb-scFv" format, with a first Fc comprising an N-terminal Fab arm binding a tumor-associated antigen and a second Fc comprising an N-terminal Fab arm binding a tumor-associated antigen and a C-terminal scFv binding CD28. The 2+1 mAb-scFv format comprises a first monomer comprising VH1-CH1-hinge-CH2-CH3, a second monomer comprising VH1-CH1-hinge-CH2-CH3-scFv, and a third monomer comprising VL-CL. The V$_L$ pairs with the first and second VH1 to form binding domains with binding specificity for the tumor-associated antigen.

FIGS. 35A and 35B depict the sequences for illustrative αB7H3ΔαCD28 bsAbs in the 1+1 Fab-scFv-Fc format. CDRs are underlined and slashes indicate the border(s) between the variable regions, linkers, Fc regions, and constant domains. It should be noted that the αB7H3ΔαCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 36A-36C depict the sequences for illustrative αB7H3ΔαCD28 bsAbs in the 2+1 Fab$_2$-scFv-Fc format. CDRs are underlined and slashes indicate the border(s) between the variable regions, linkers, Fc regions, and constant domains. The scFv domain has orientation (N- to C-terminus) of V$_H$-scFv linker-V$_L$, although this can be reversed. It should be noted that the scFv domain sequences includes as the scFv linker between the variable heavy and variable light region the sequence GKPGSGKPGSGKPGSGKPGS (SEQ ID NO:796); however, this linker can be replaced with any of the scFv linkers in FIG. 6. It should also be noted that the Chain 2 sequences include as the domain linker between the C-terminus of the scFv and the N-terminus of the CH2 domain the sequence GGGGSGGGGSKTHTCPPCP (SEQ ID NO:818), which is a "flex half hinge" domain linker; however, this linker can be replaced with any of the "useful domain linkers" of FIG. 7. It should be noted that the αB7H3ΔαCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 37 depicts the sequences for illustrative αB7H3ΔαCD28 bsAbs in the 1+1 CLC format. CDRs are underlined and slashes indicate the border(s) between the variable regions, linkers, Fc regions, and constant domains. It should be noted that the αB7H3×αCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 38A-38E depicts the sequences for illustrative αB7H3ΔαCD28 bsAbs in the 2+1 CLC format. CDRs are underlined and slashes indicate the border(s) between the variable regions, linkers, Fc regions, and constant domains. The scFv domain has orientation (N- to C-terminus) of V$_H$-scFv linker-V$_L$, although this can be reversed. It should be noted that the Chain 2 sequences include as a domain linker (double underlined) the sequence EPKSCGKPGSGKPGS (SEQ ID NO:1182); however, this linker can be replaced with any domain linker include any of the "useful domain linkers" of FIG. 6. It should be noted that the αB7H3ΔαCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 39A-39E depict the sequences for illustrative αB7H3ΔαCD28 bsAbs in the 2+1 mAb-scFv format. CDRs are underlined and slashes indicate the border(s) between the variable regions, linkers, Fc regions, and constant domains. The scFv domain has orientation (N- to C-terminus) of V$_H$-scFv linker-V$_L$, although this can be reversed. It should be noted that the Chain 2 sequences include as a domain linker the sequence GKPGSGKPGSGKPGSGKPGS (SEQ ID NO:796); however, this linker can be replaced with any domain linker include any of the "useful domain linkers" of FIG. 6. It should be noted that the αB7H3ΔαCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

Figure 40A:
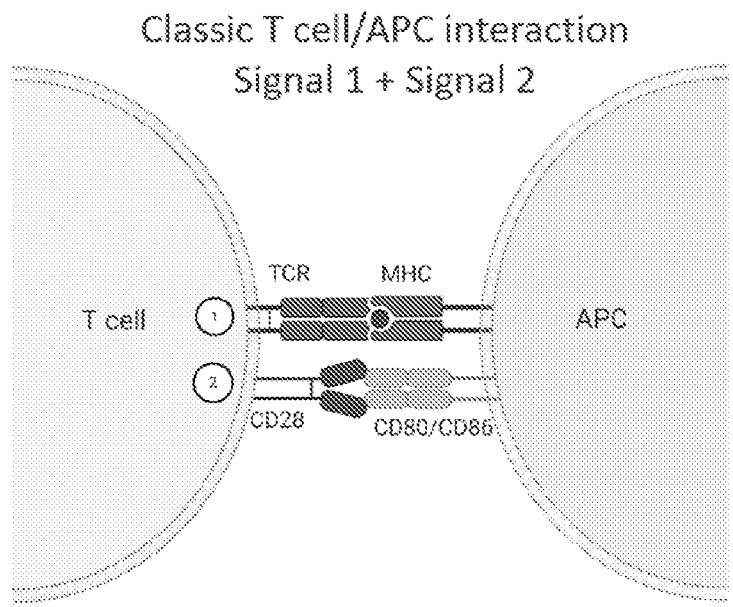
Figure 40B:
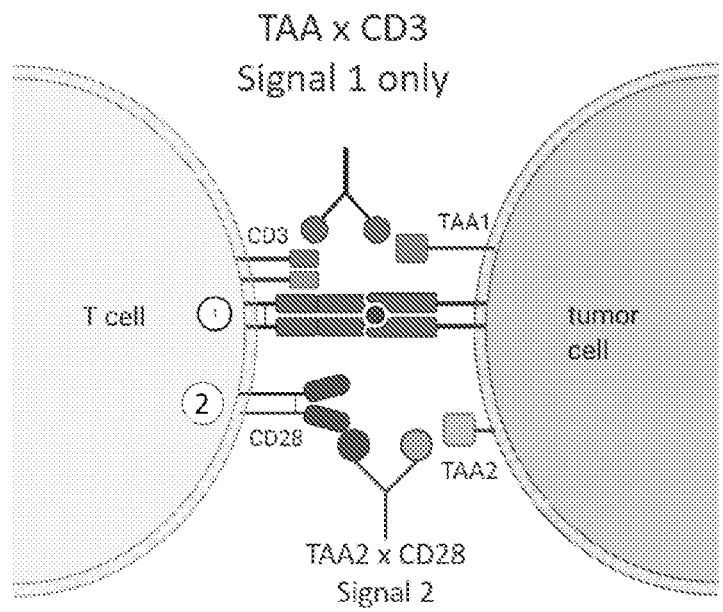

FIGS. 40A and 40B depict A) classic T cell/APC interaction and B) replication of the classic T cell/APC interaction by combining CD3 bispecific antibodies with CD28 bispecific antibodies. In classic T cell/APC interaction, there is a first signal provided by TCR reactivity with peptide-MHC (Signal 1) and a second signal provided by CD28 crosslinking by CD80/CD86 being expressed on APCs (Signal 2) which together fully activate T cells. In contrast in treatment with CD3 bispecifics, only the first signal is provided. The CD28 signal may be provided by a CD28 bispecific with the idea to promote activation and proliferation through CD28 costimulation.

Figure 41:
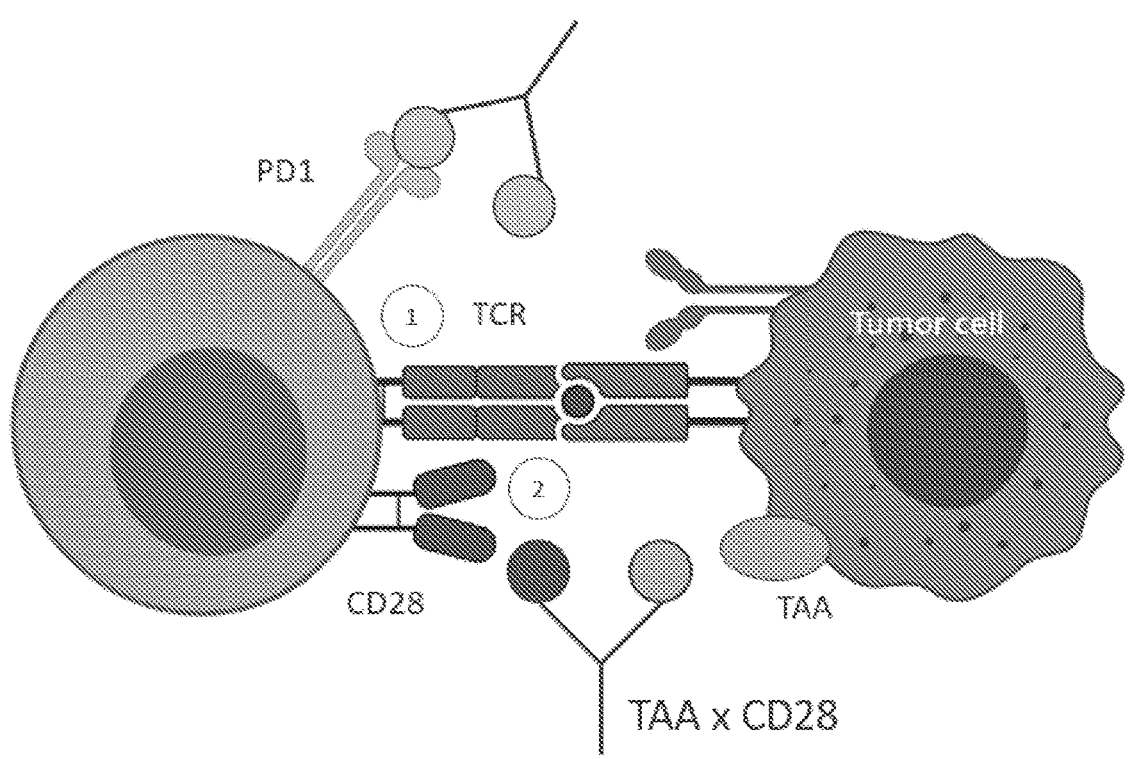

FIG. 41 depicts the introduction of CD28 signaling by a CD28 bispecific antibody and mitigation of any checkpoint mediated repression of the added CD28 signal by checkpoint blockade (e.g. PD-1 blockade).

Figure 42:
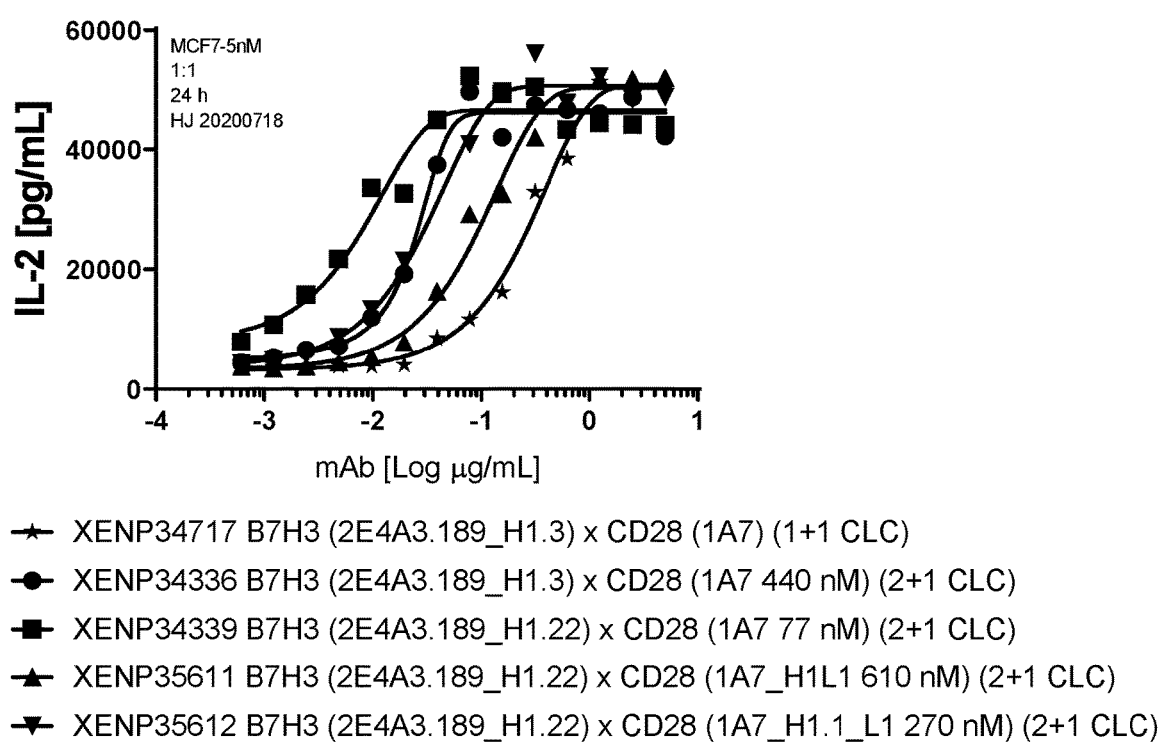

FIG. 42 depicts induction of IL-2 release by effector cells in the presence of MCF7 cancer cells transfected with anti-CD3 scFv (1:1 effector:target ratio) and B7H3×CD3 bsAbs XENP34339, XENP35612, XENP35611, and XENP34336 (respectively having CD28 binding affinities of 77 nM, 270 nM, 610 nM, and 440 nM). The data show that reducing CD28 binding affinity reduces potency of the B7H3×CD28 bispecific antibodies.

Figure 43A:
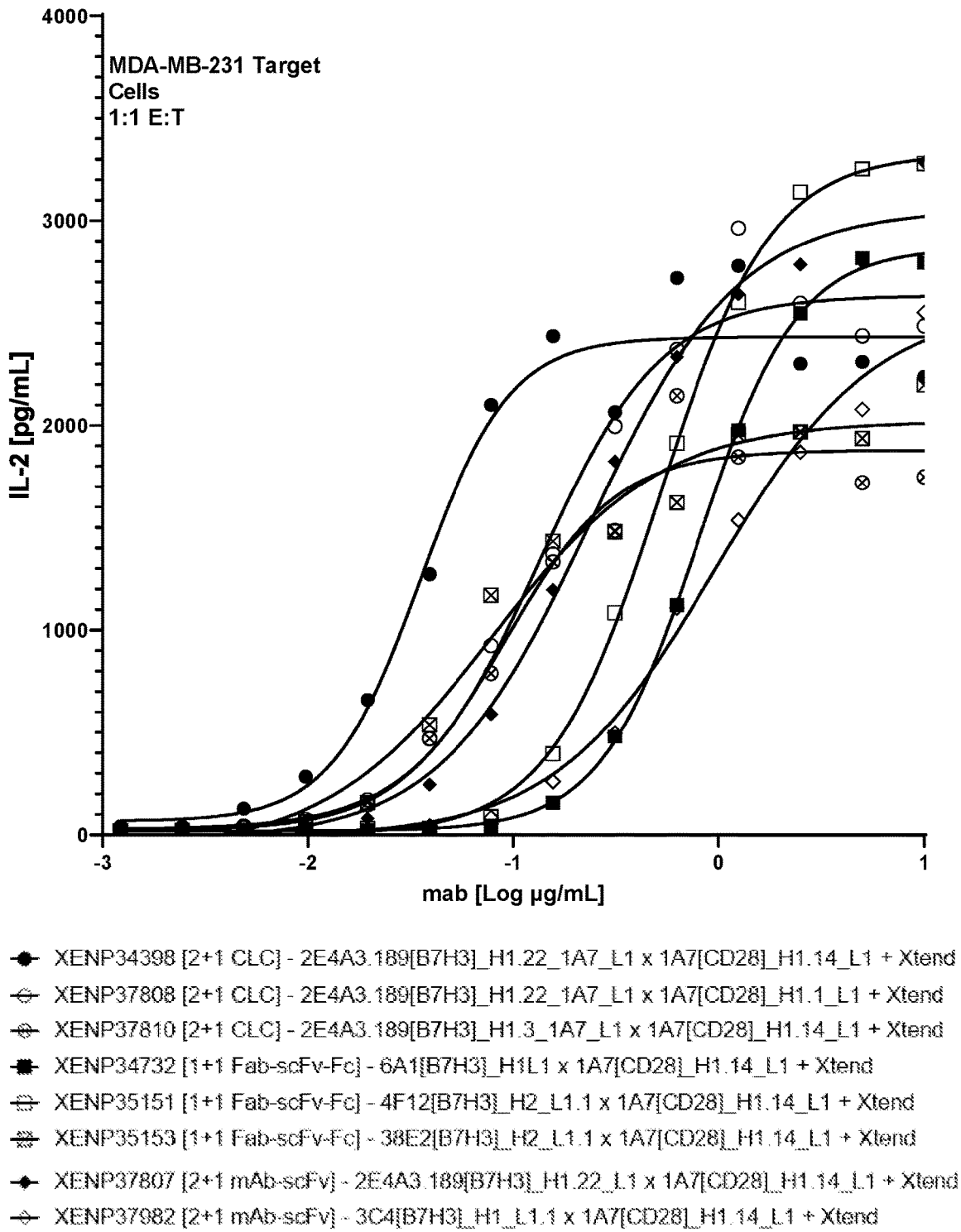
Figure 43B:
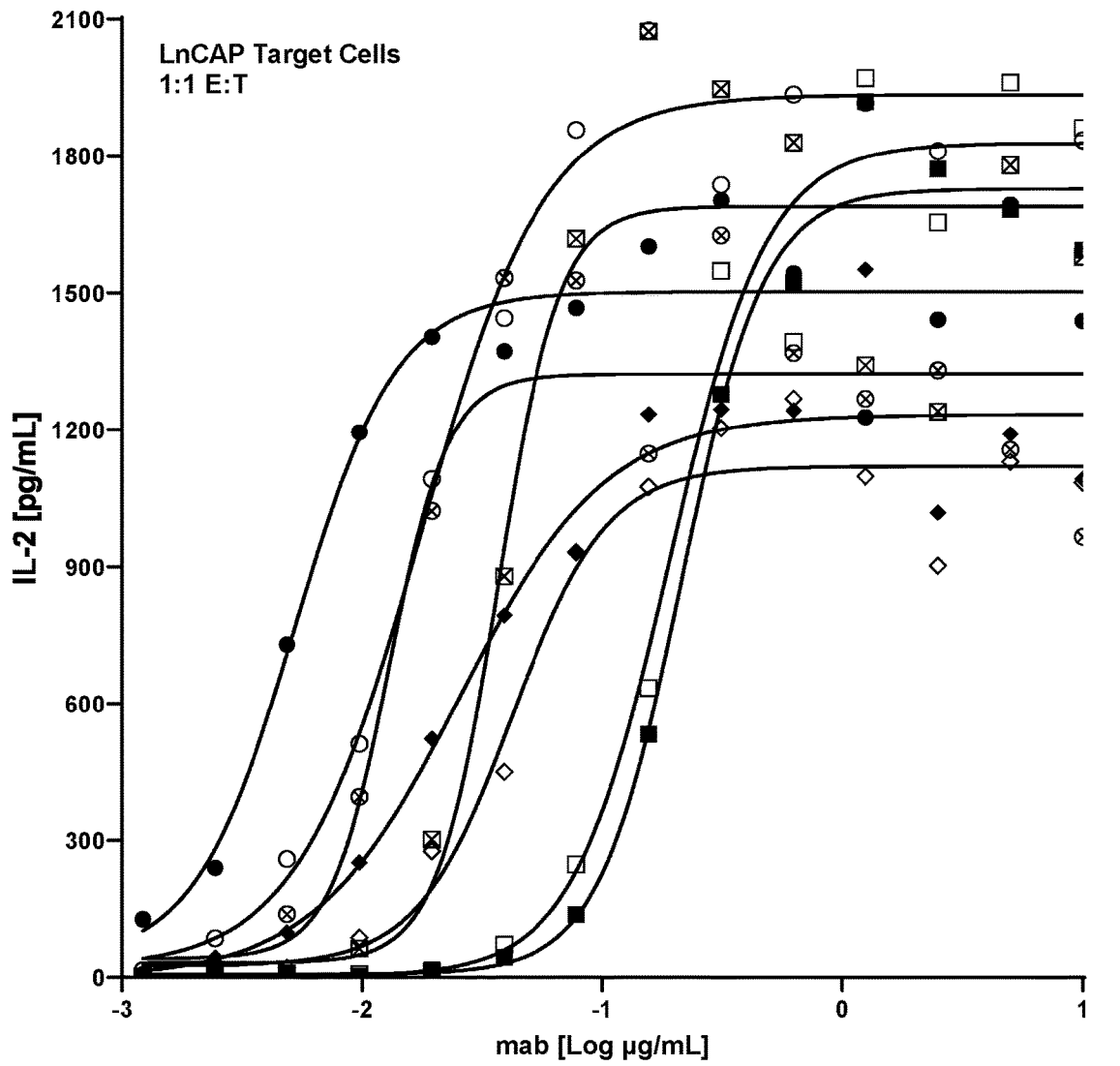
Figure 43C:
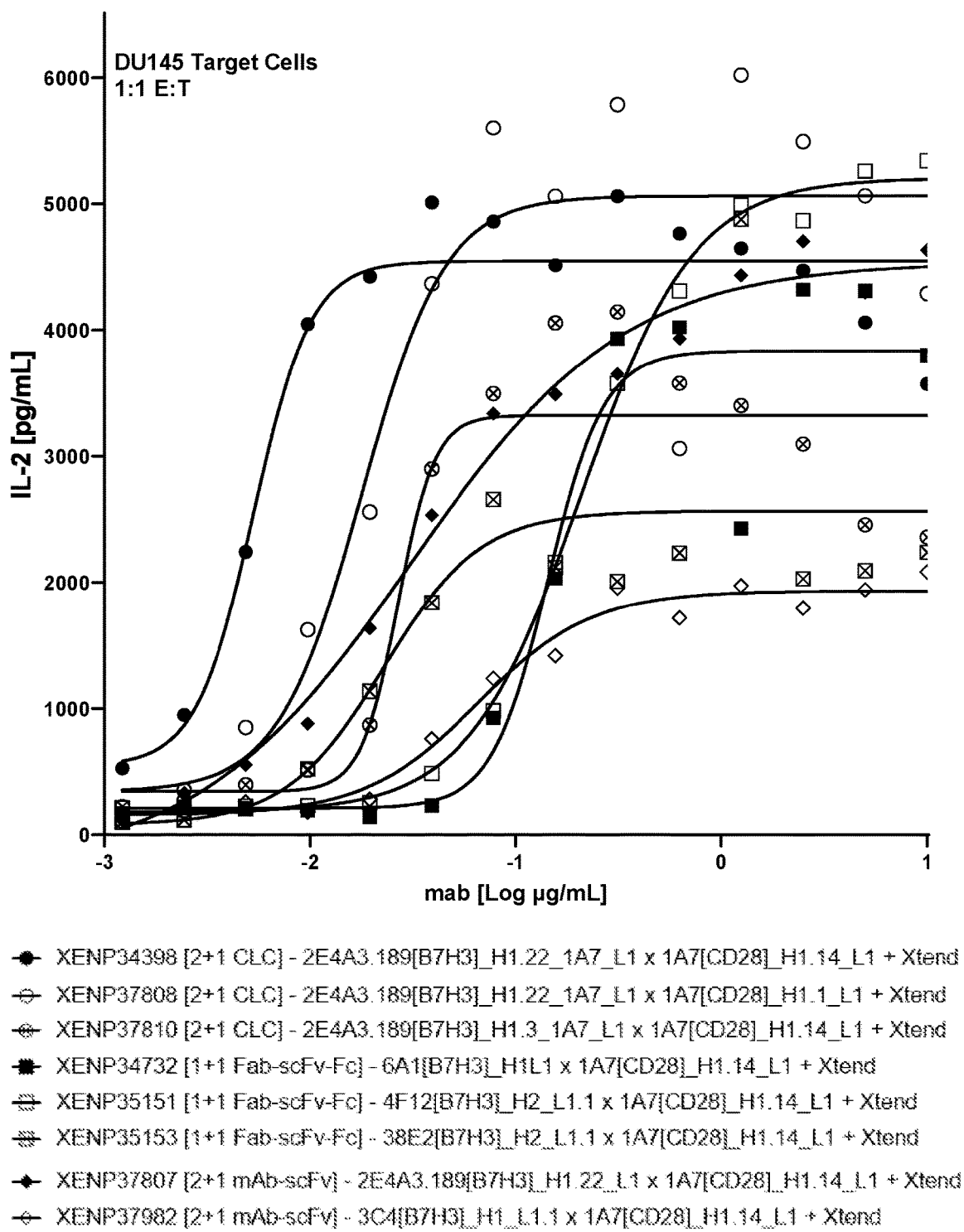

FIGS. 43A-43C depict induction of IL-2 secretion from T cells by B7H3×CD28 bsAbs in the presence of A) MDA-MB-231, B) LnCAP, and C) DU145 target cells (1:1 E:T ratio) and a constant dose of a illustrative B7H3×CD3 bsAb.

FIG. 44 depicts consensus framework regions (FR) and complementarity determining regions (CDRs) (as in Kabat) for anti-CD28 clone 1A7 variable heavy and variable light domain variants.

FIGS. 45A-45D depict the pharmacokinetics of B7H3× CD28 bsAbs in various antibody formats in a cynomolgus study. The data show that at each dose level investigated, the 2+1 common light chain format had the best half-life and pharmacokinetics.

FIGS. 46A-46H depict the change in serum concentration level over time in cynomolgus monkeys dosed with A) XENP34398, B) XENP37808, C) XENP37810, D) XENP34732, E) XENP35151, F) XENP351535, G) XENP37807, and H) XENP37982. Relative doses are depicted as follows: circle for 0.5× dose; upside down triangle for 1.3× dose; hexagon for 1.8× dose; square for 2× dose; diamond for 3.25× dose; star for 4.5× dose; and triangle for 5× dose.

FIG. 47 summarizes properties of B7H3×CD28 bsAbs XENP34398, XENP37808, XENP34732, and XENP35153. It should be noted that some of the data depicted in this summary table may not be the same experimental data depicted elsewhere in the Working Examples as some of those illustrate experimental data from earlier stages of development.

Figure 48A:
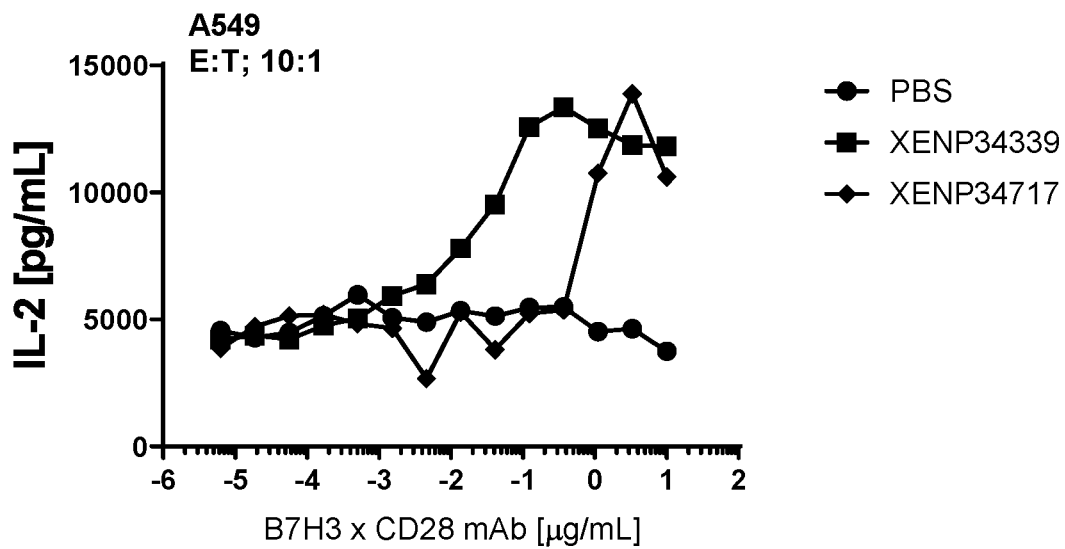
Figure 48B:
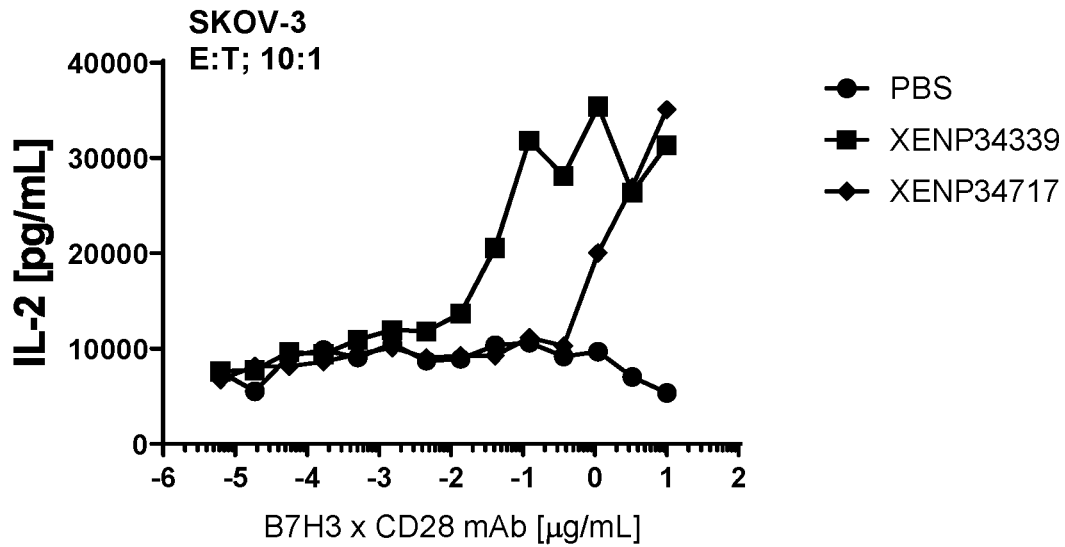

FIGS. 48A and 48B depict IFNγ release following incubation of A) A549 cancer cells and B) SKOV-3 cancer cells with CD3+ T cells (10:1 effector:target ratio) and indicated concentration of B7H3×CD28 bispecific antibodies XENP34339 or XENP34717. The data show that both XENP34339 and XENP34717 induced cytokine release by the T cells. XENP34339 having bivalent B7H3 binding induced cytokine release more potently than XENP34717 having monovalent B7H3 binding.

Figure 49:
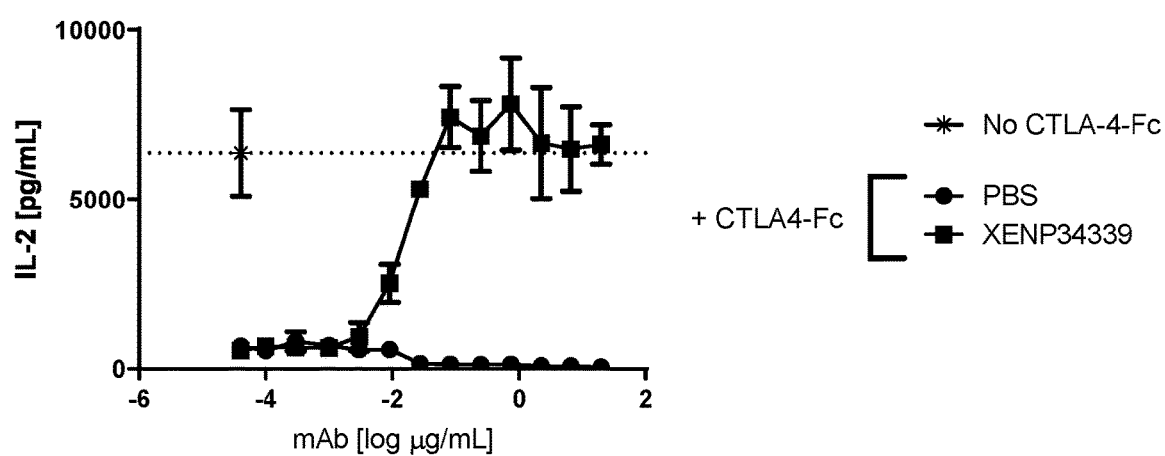

FIG. 49 depicts the restoration of CD28 signaling in a mixed lymphocyte reaction (following incubation of with 1 µg/mL CTLA-4-Fc) by XENP34339. Error bars represent the mean expression in culture supernatants from one MLR reaction tested in technical quadruplicate.

Figure 50A:
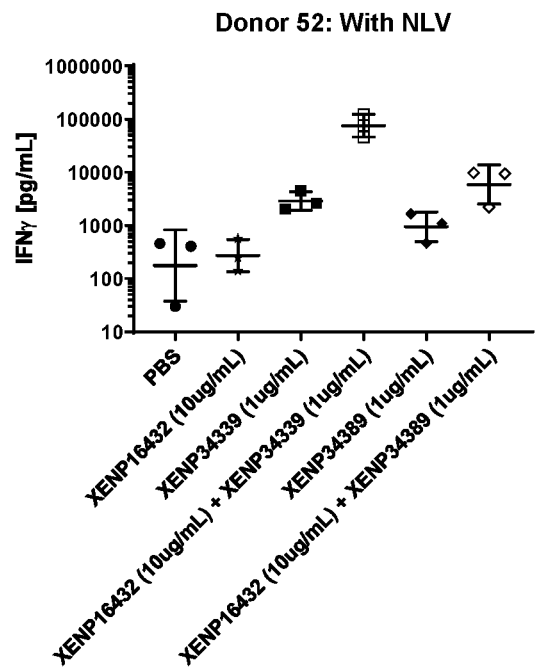
Figure 50B:
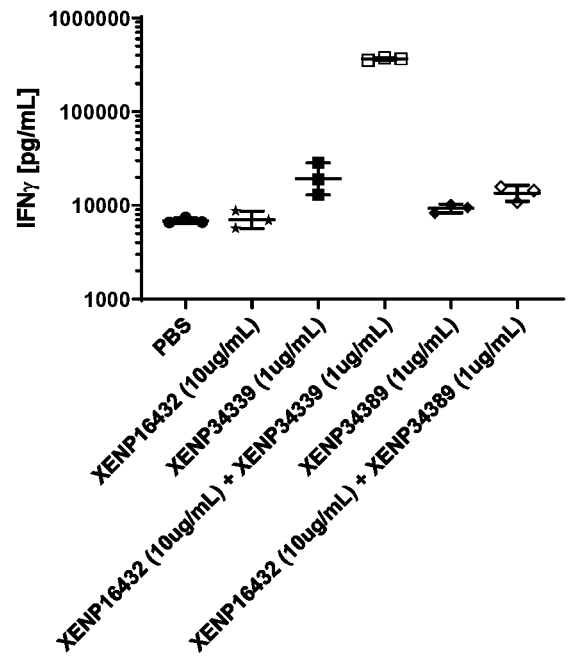

FIGS. 50A and 50B depict IFNγ release following incubation of NLV-loaded MDA-MB-231 cancer cells with CD3+ T cells purified from A) a first donor and B) a second donor at a 10:1 effector:target ratio and the indicated combinations of XENP16432, XENP34339, and XENP34389. The data show that incubation with XENP34339 alone induced cytokine release from T cells and combined synergistically with PD-1 blockade to enhance cytokine release.

Figure 51:
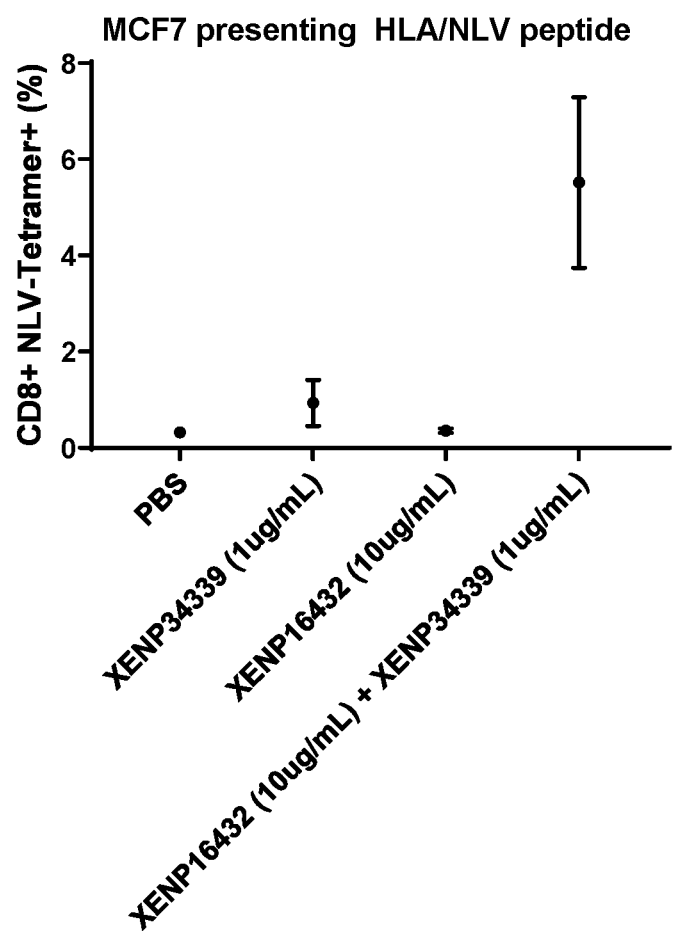

FIG. 51 depicts expansion of NLV-tetramer positive cells following incubation of NLV-loaded MCF7 cancer cells with purified CD3+ T cells purified at a 10:1 effector:target ratio and the indicated combinations of XENP16432 and XENP34339. The data show that combination of XENP34339 with PD-1 blockade enhanced expansion of NLV-tetramer positive CD8+ T cells.

Figure 52A:
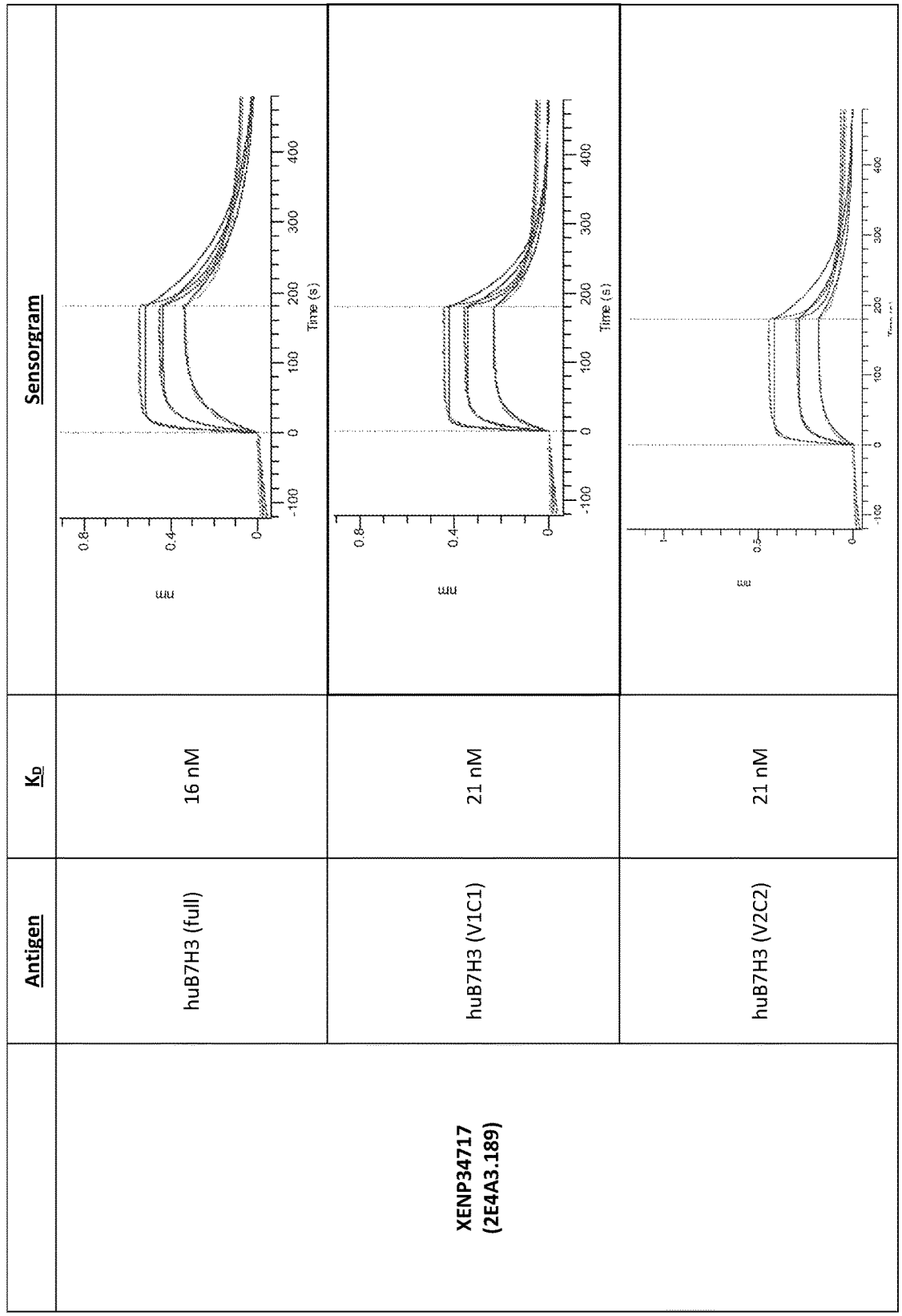
Figure 52B:
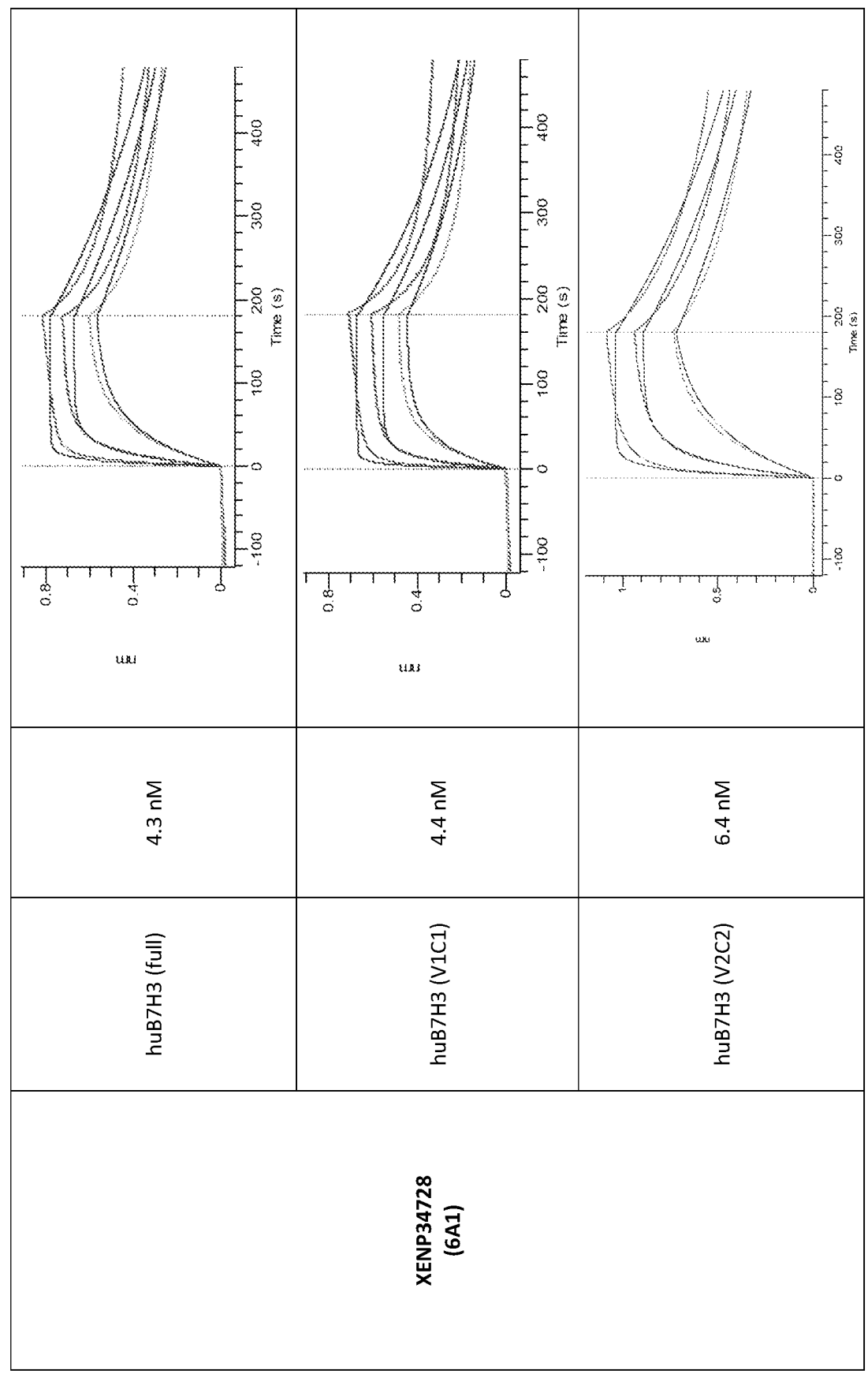

FIGS. 52A and 52B depicts the dissociation constant ($K_D$; and corresponding sensorgrams) of anti-B7H3 clone 2E4A3.189 and clone 6A1 for either the full B7H3 extracellular V1C1-V2V2 domain or the individual V1C1 or V2C2 domains.

Figure 53:
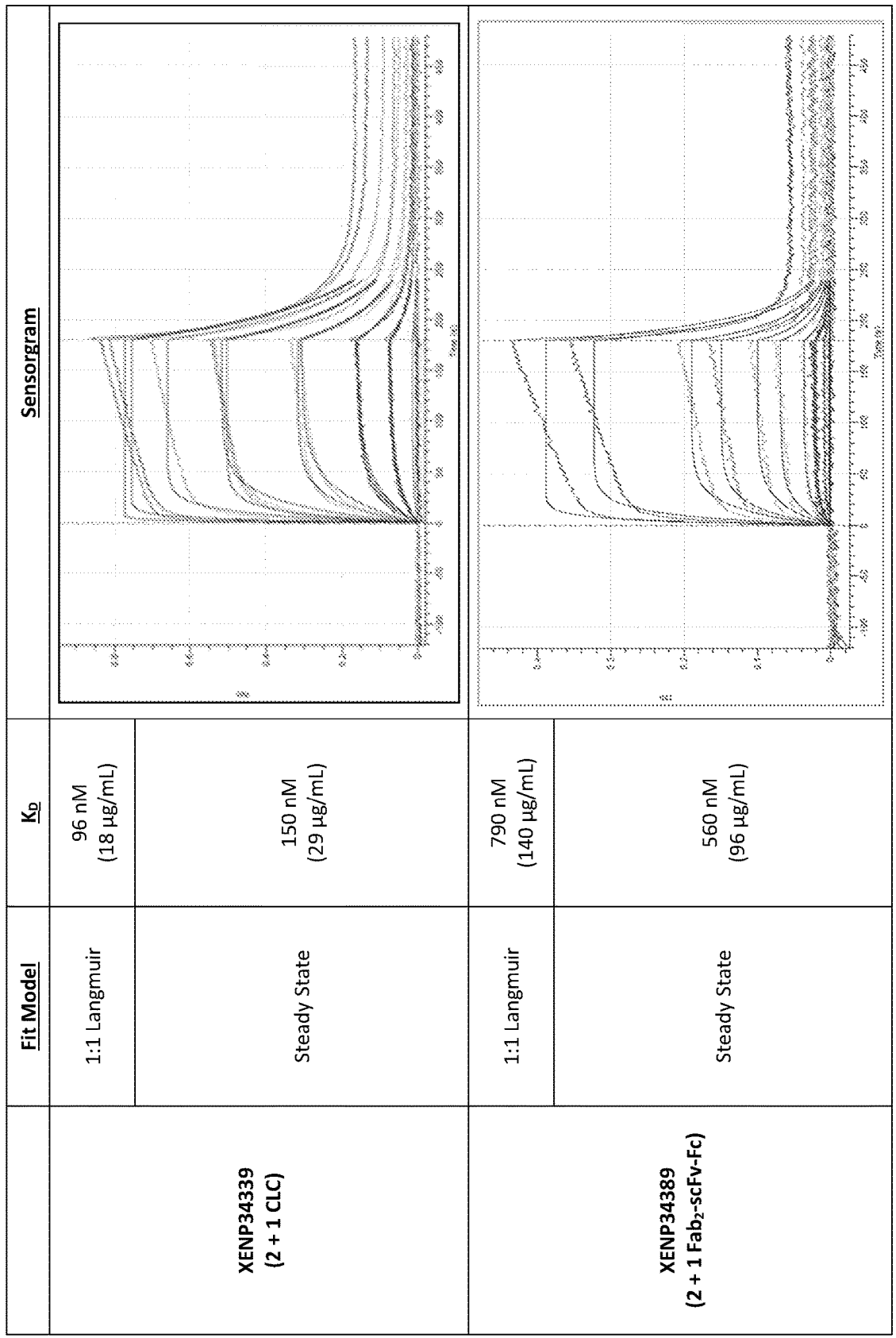

FIG. 53 depicts the dissociation constant ($K_D$; and corresponding sensorgrams) of anti-CD28 clone 1A7 affinity variant H1.14_L1 as a Fab in the 2+1 CLC format or as an scFv in the 2+1 Fab$_2$-scFv-Fc format for CD28 antigen.

FIGS. 54A and 54B depict the sequences for illustrative αPSMA×αCD3 bsAbs in the 2+1 Fab$_2$-scFv-Fc format and comprising a H1.30 L1.47 anti-CD3 scFv (a.k.a. CD3 High [VHVL]). CDRs are underlined and slashes indicate the border(s) between the variable regions and other chain components (e.g. constant region and domain linkers). It should be noted that the αPSMA×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

Figure 55:
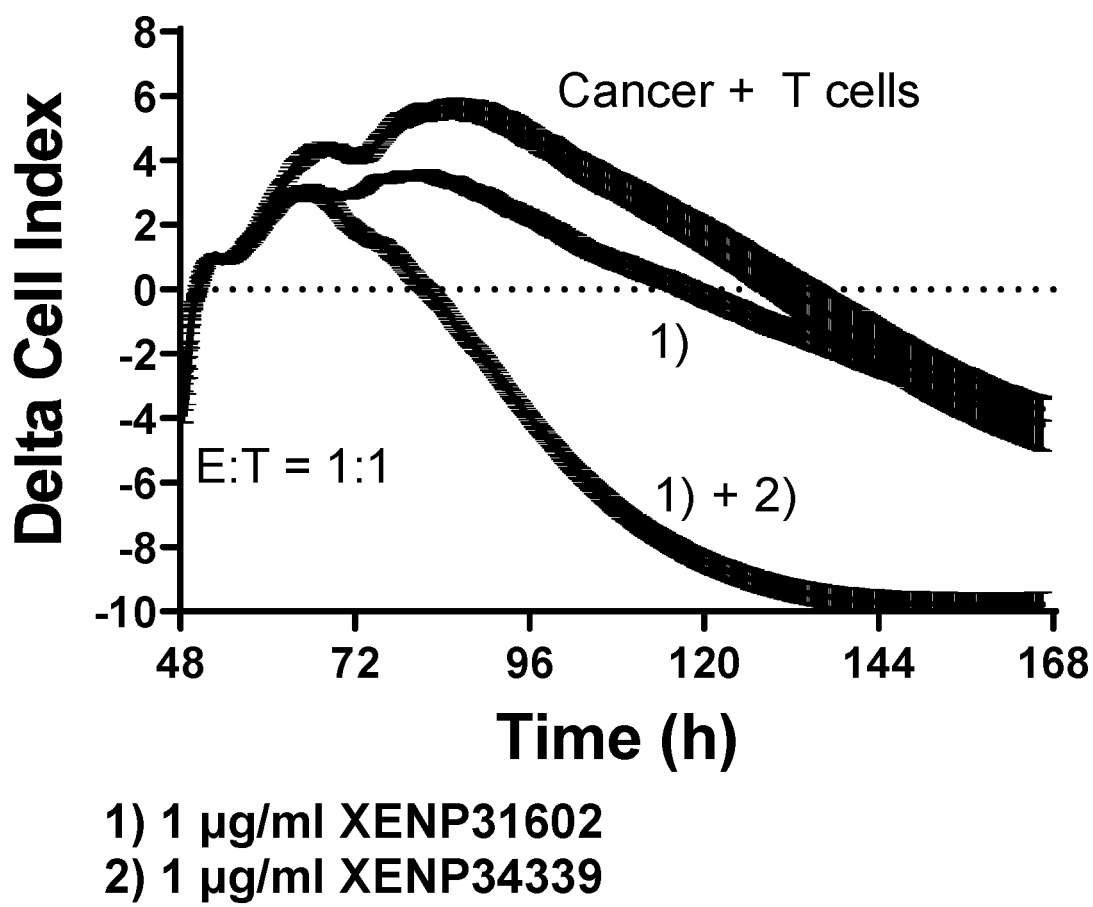

FIG. 55 depicts cell kill over time following incubation of LNCaP cancer cells (PSMA$^+$B7H3$^+$) with CD3$^+$ T cells at a 1:1 effector:target ratio and illustrative CD3 bispecific (αPSMA×αCD3 XENP31602) alone or in combination with XENPXENP34339 at the indicated concentrations. The data show that XENP31602 αPSMA×αCD3 alone minimally enhanced cell kill in comparison to incubation of cancer and T cells alone. Addition of XENP34339 αB7H3ΔαCD28 overcomes cancer cell resistance to the CD3 bispecific.

FIGS. 56A-56L depict sequences for exemplary anti-CD3 binding domains suitable for use in CD3 bispecific antibodies which may be combined with the CD28 bispecific antibodies of the invention. The CDRs are underlined, the scFv linker is double underlined (in the sequences, the scFv linker is a positively charged scFv (GKPGS)$_4$ linker (SEQ ID NO: 796), although as will be appreciated by those in the art, this linker can be replaced by other linkers, including uncharged or negatively charged linkers, some of which are depicted in FIG. 6), and the slashes indicate the border(s) of the variable domains. In addition, the naming convention illustrates the orientation of the scFv from N- to C-terminus. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIGS. 57A-57C depict A) IFNγ release, B) IL-2 release, and C) CD3$^+$ T cell expansion following incubation of LNCaP cancer cells (PSMA$^+$B7H3$^+$) with CD3$^+$ T cells at a 1:1 effector:target ratio and 1 µg/ml XENP34339 in combination with a dose titration of an illustrative CD3 bispecific (αPSMA×αCD3 XENP31602).

Figure 58A:
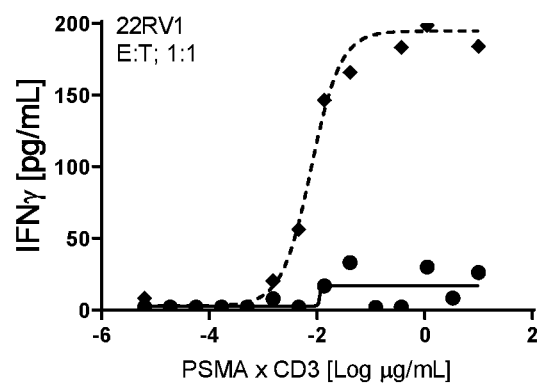
Figure 58B:
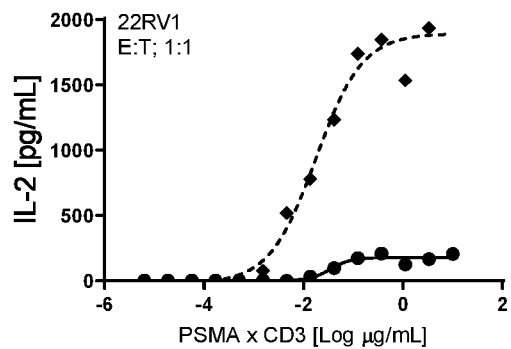
Figure 58C:
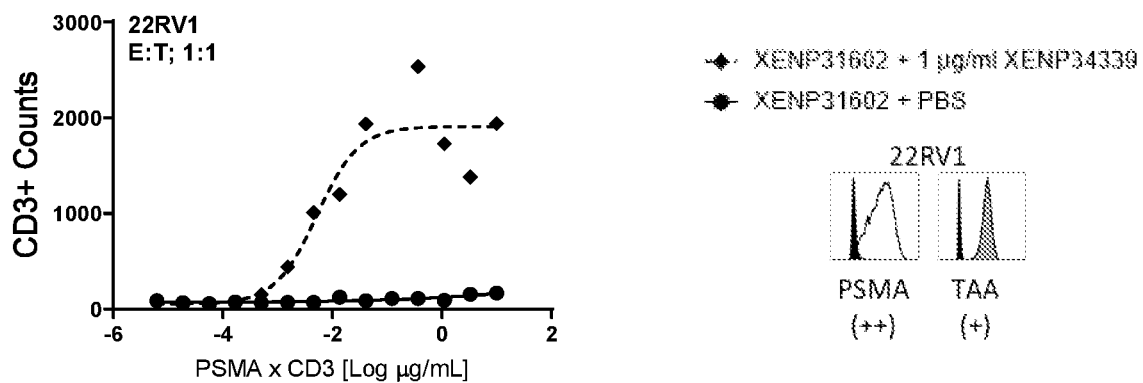

FIGS. 58A-58C depict A) IFNγ release, B) IL-2 release, and C) CD3$^+$ T cell expansion following incubation of 22Rv1 cancer cells (PSMA$^+$B7H3$^+$) with CD3$^+$ T cells at a 1:1 effector:target ratio and 1 µg/ml XENP34339 in combination with a dose titration of an illustrative CD3 bispecific (αPSMA×αCD3 XENP31602).

Figure 59A:
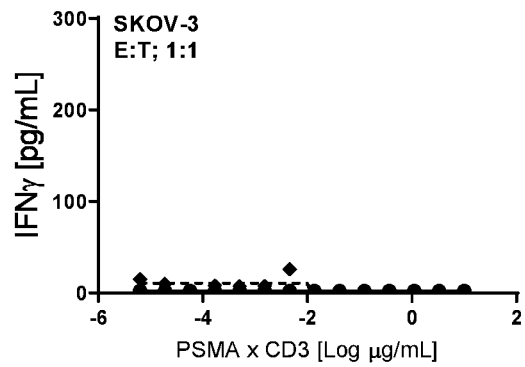
Figure 59B:
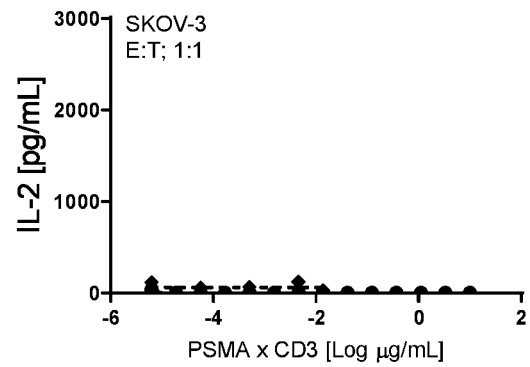
Figure 59C:
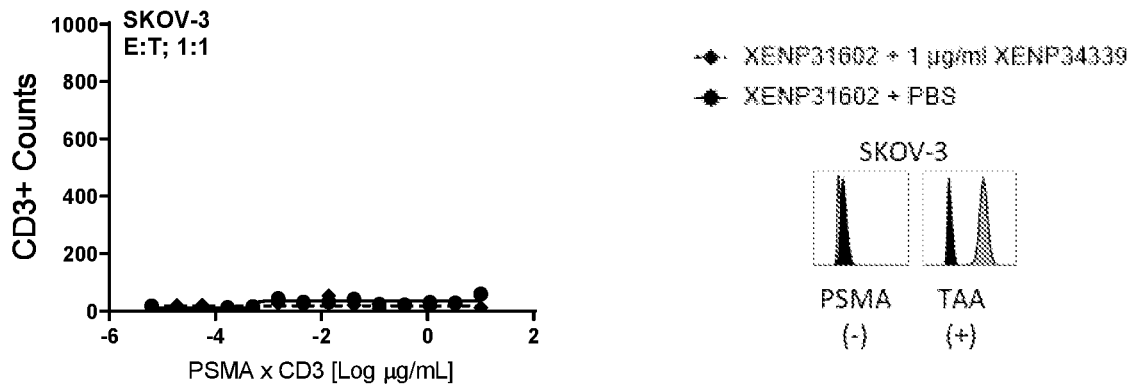

FIGS. 59A-59C depict A) IFNγ release, B) IL-2 release, and C) CD3$^+$ T cell expansion following incubation of SKOV-3 cancer cells (PSMA$^-$B7H3$^+$) with CD3$^+$ T cells at a 1:1 effector:target ratio and 1 µg/ml XENP34339 in combination with a dose titration of an illustrative CD3 bispecific (αPSMA×αCD3 XENP31602).

Figure 60A:
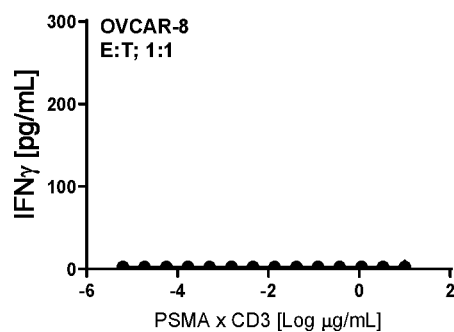
Figure 60B:
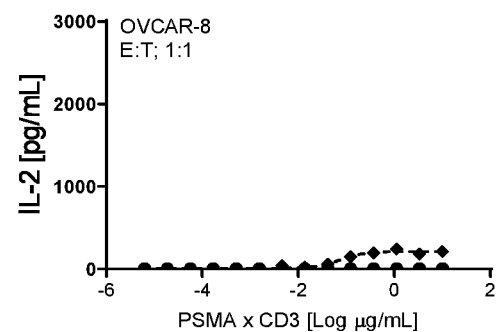
Figure 60C:
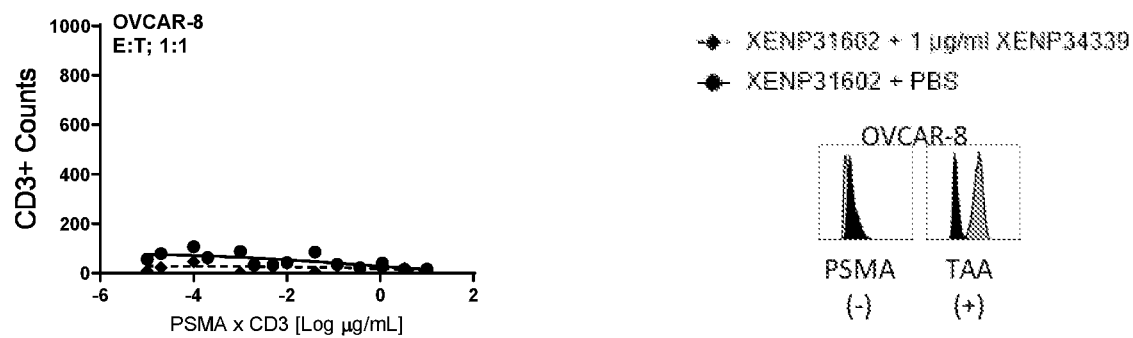
Figure 61A:
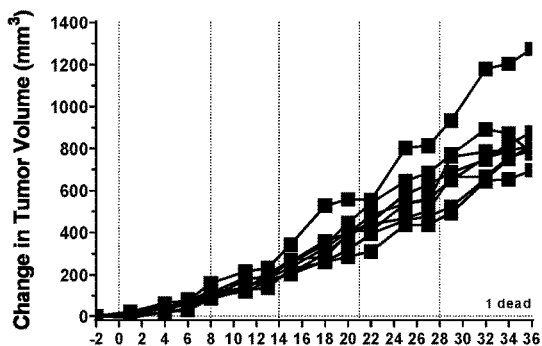
Figure 61B:
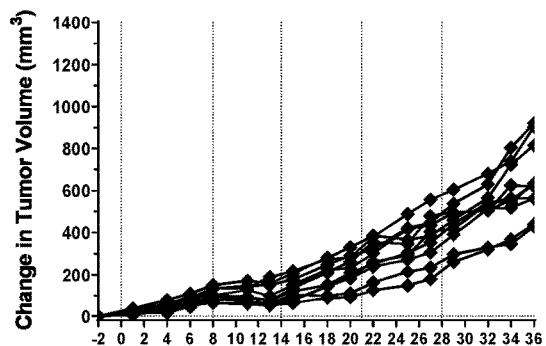
Figure 61C:
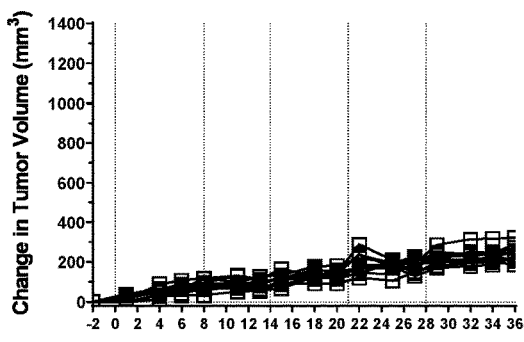
Figure 61D:
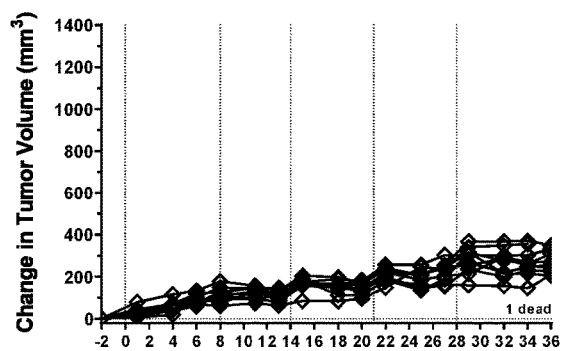
Figure 61E:
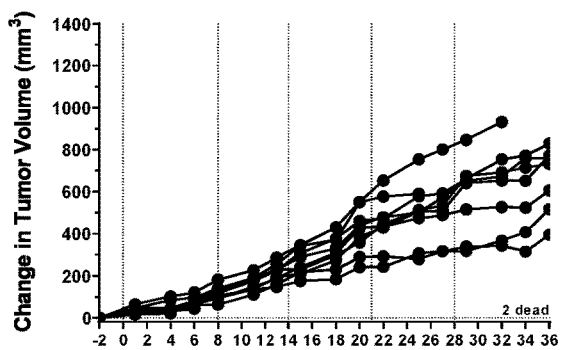

FIGS. 60A-60C depict A) IFNγ release, B) 1L-2 release, and C) CD3$^+$ T cell expansion following incubation of OVCAR-8 cancer cells (PSMA$^-$B7H3$^+$) with CD3$^+$ T cells at a 1:1 effector:target ratio and 1 µg/ml XENP34339 in combination with a dose titration of an illustrative CD3 bispecific (αPSMA×αCD3 XENP31602).

FIGS. 61A-61E depict change in tumor volume (as determined by caliper measurement; baseline corrected) in individual mouse over time (in days) in pp65-MDA-MB-231 and huPBMC-engrafted NSG mice dosed with A) a first illustrative B7H3×CD3 bispecific antibody (CD3bsAb1) (0.5 mg/kg) alone, B) a second illustrative B7H3×CD3 bispecific antibody (CD3bsAb2) (0.5 mg/kg) alone, C) a combination of XENP34339 (5.0 mg/kg) with CD3bsAb1

Figure 62:
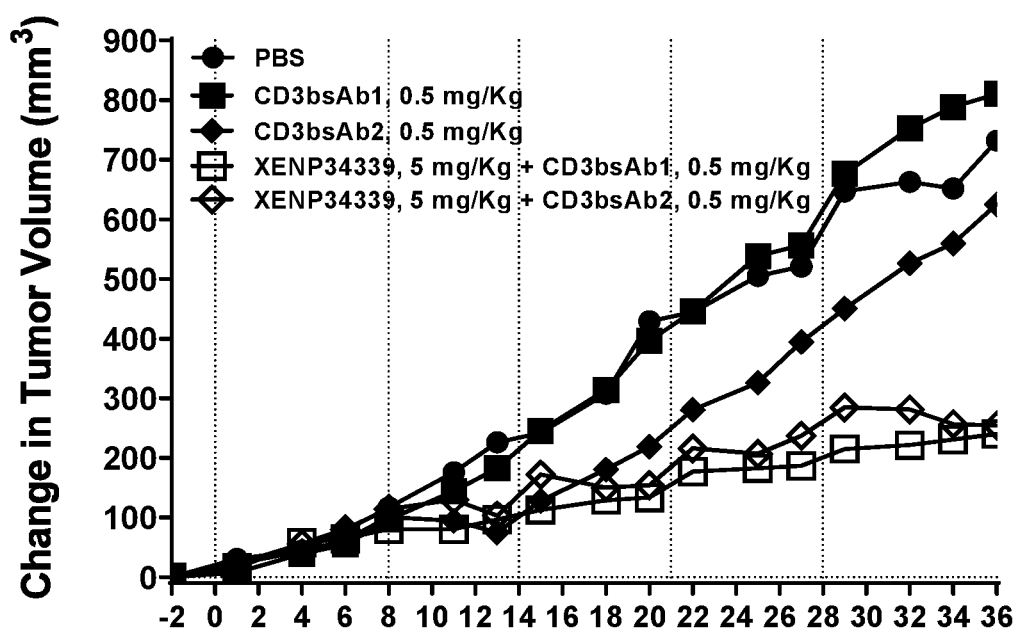

(0.5 mg/kg), D) a combination of XENP34339 (5.0 mg/kg) with CD3bsAb2 (0.5 mg/kg), or E) PBS. F) depicts FIG. 62 depicts group median change in tumor volume (as determined by caliper measurement; baseline corrected) over time (in days) in pp65-MDA-MB-231 and huPBMC-engrafted NSG mice dosed with a first illustrative B7H3×CD3 bispecific antibody (CD3bsAb1) (0.5 mg/kg) alone, a second illustrative B7H3×CD3 bispecific antibody (CD3bsAb2) (0.5 mg/kg) alone, a combination of XENP34339 (5.0 mg/kg) with CD3bsAb1 (0.5 mg/kg), a combination of XENP34339 (5.0 mg/kg) with CD3bsAb2 (0.5 mg/kg), or PBS control.

Figure 63:
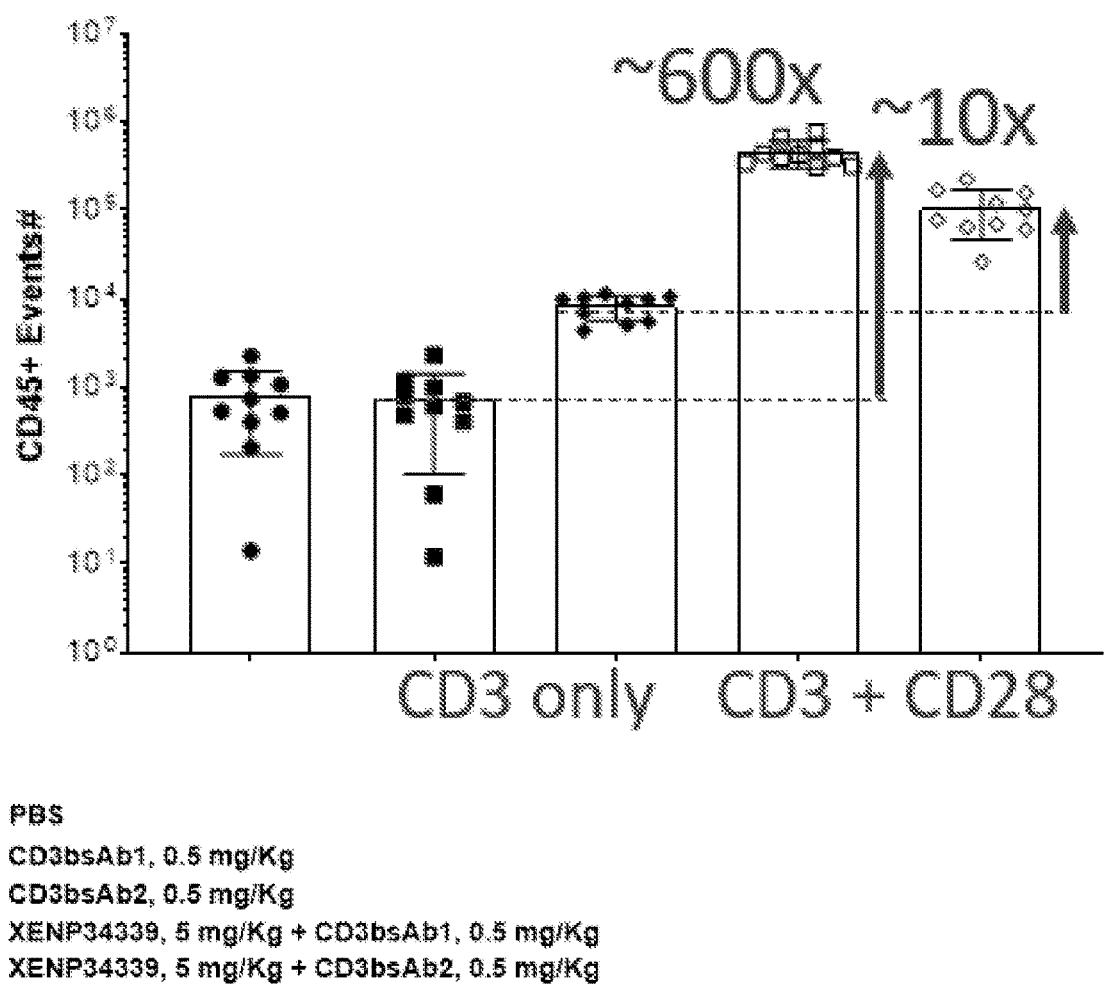
Figure 64A:
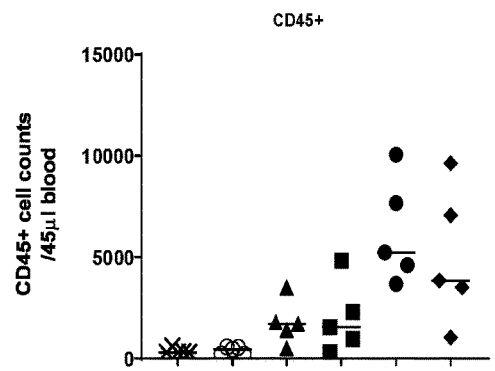
Figure 64B:
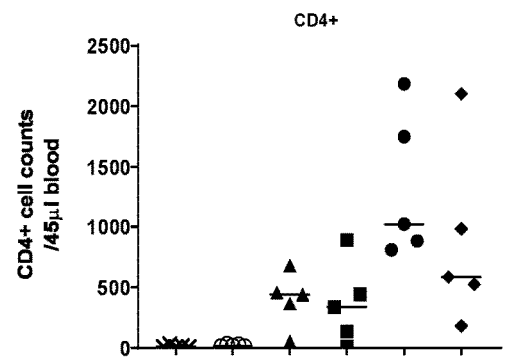
Figure 64C:
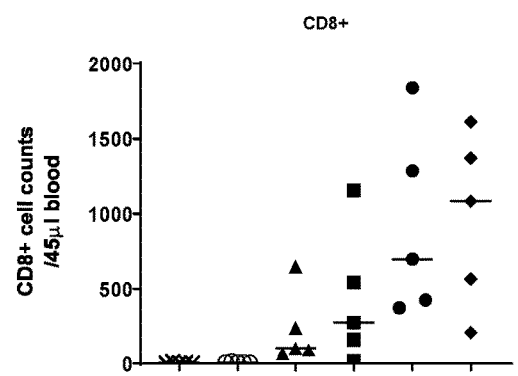
Figure 64D:
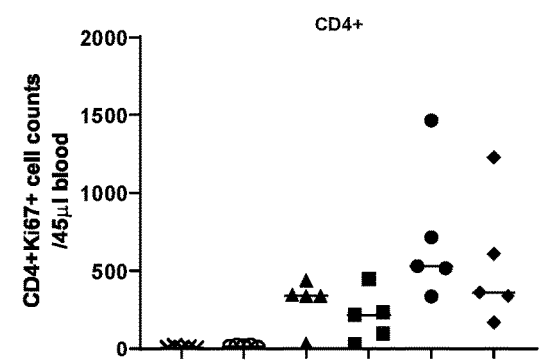
Figure 64E:
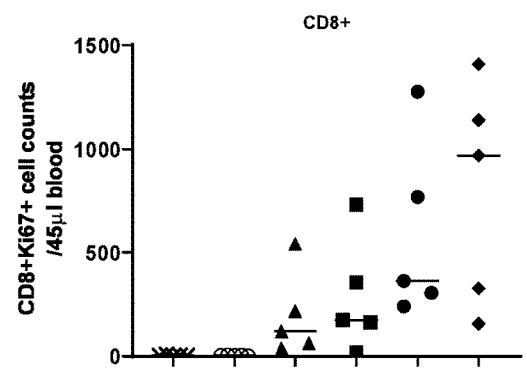
Figure 65A:
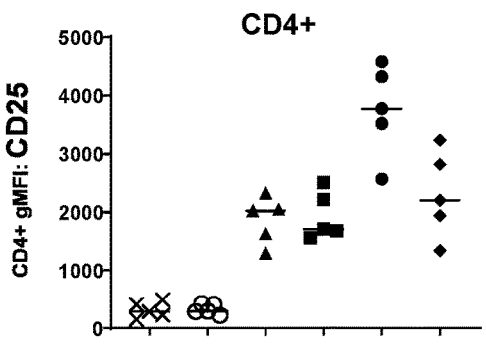
Figure 65B:
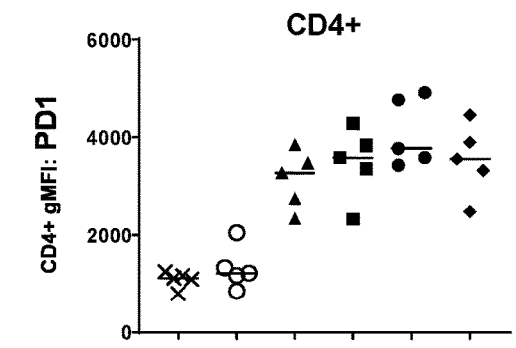
Figure 65C:
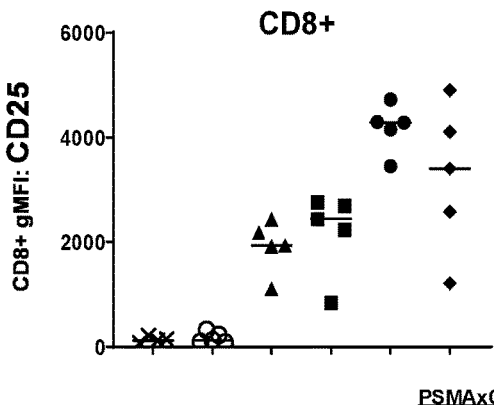
Figure 65D:
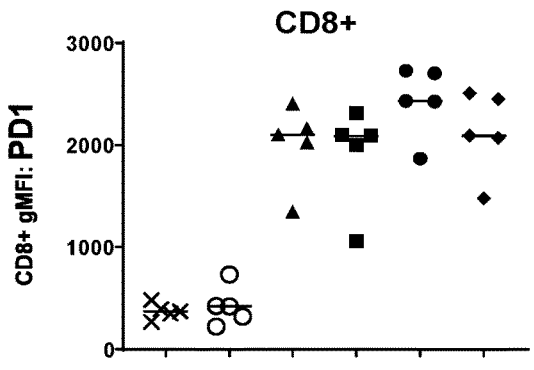

FIG. 63 depicts CD45+ cell counts in blood of pp65-MDA-MB-231 and huPBMC-engrafted NSG mice dosed with a first illustrative B7H3×CD3 bispecific antibody (CD3bsAb1) (0.5 mg/kg) alone, a second illustrative B7H3×CD3 bispecific antibody (CD3bsAb2) (0.5 mg/kg) alone, a combination of XENP34339 (5.0 mg/kg) with CD3bsAb1 (0.5 mg/kg), a combination of XENP34339 (5.0 mg/kg) with CD3bsAb2 (0.5 mg/kg), or PBS control on Day 14 after first dose.

FIGS. 64A-64E depict expansion of A) CD45+, B) CD4+ (all), C) CD8+(all), D) CD4+(Ki67+), and E) CD8+(Ki67+) cells in blood (as indicated by count) of 22RV1 and huPBMC-engrafted NSG-DKO mice dosed with a low or high concentration doses of illustrative PSMA×CD3 bsAb XENP32220 alone or in combination with XENP34339. Treatment with both CD3 and CD28 bsAbs enhanced T cell expansion in comparison to treatment with CD3 bsAb alone.

FIGS. 65A-65D depicts A) activation of CD4+ cells (as indicated by CD25 expression), B) activation of CD4+ cells (as indicated by PD1 expression), C) activation of CD8+ cells (as indicated by CD25 expression), and D) activation of CD8+ cells (as indicated by PD1 expression) in blood (as indicated by count) of 22RV1 and huPBMC-engrafted NSG-DKO mice dosed with a low or high concentration doses of illustrative PSMA×CD3 bsAb XENP32220 alone or in combination with XENP34339. Treatment with both CD3 and CD28 bsAbs enhanced T cell activation in comparison to treatment with CD3 bsAb alone.

Figure 66:
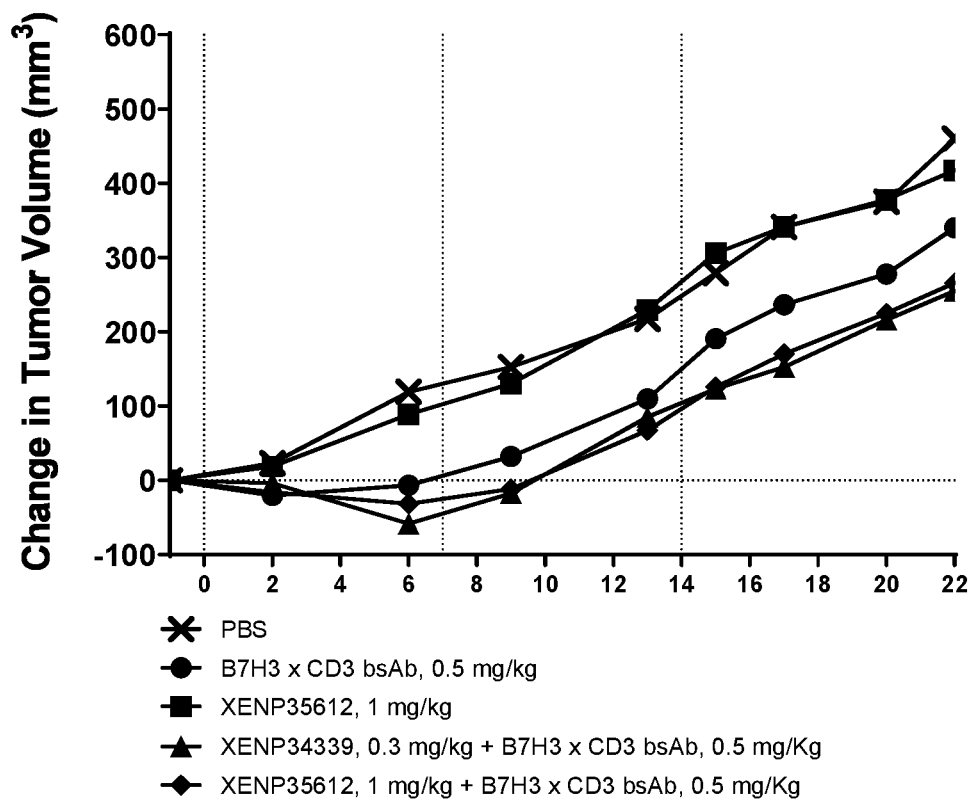

FIG. 66 depicts group median change in tumor volume (as determined by caliper measurement; baseline corrected) over time (in days) in pp65-MDA-MB-231-engrafted CD34+ Hu-NSG mice dosed with an illustrative B7H3×CD3 bispecific antibody (0.5 mg/kg) alone, XENP35612 alone (1 mg/kg) alone, a combination of XENP34339 (0.3 mg/kg) with the B7H3×CD3 bsAb (0.5 mg/kg), a combination of XENP35612 (1 mg/kg) with the B7H3×CD3 bsAb (0.5 mg/kg), or PBS control.

Figure 67A:
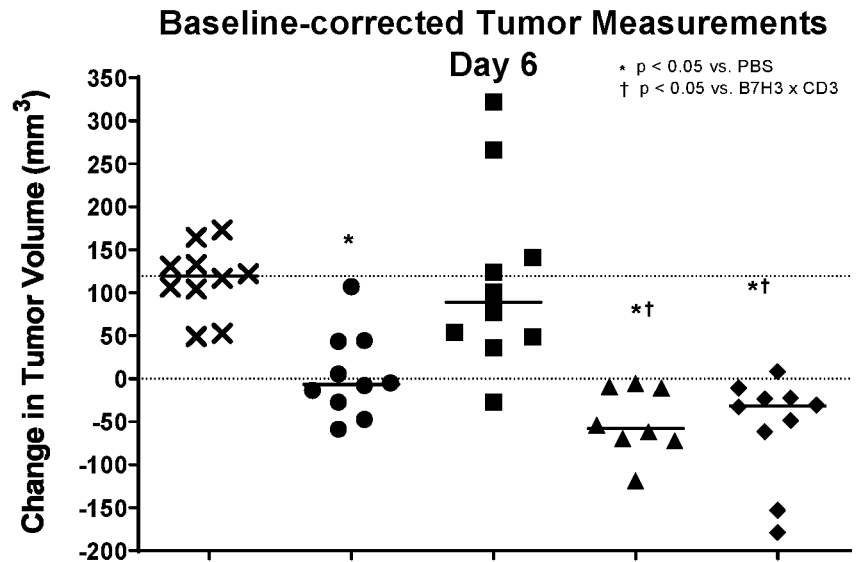
Figure 67B:
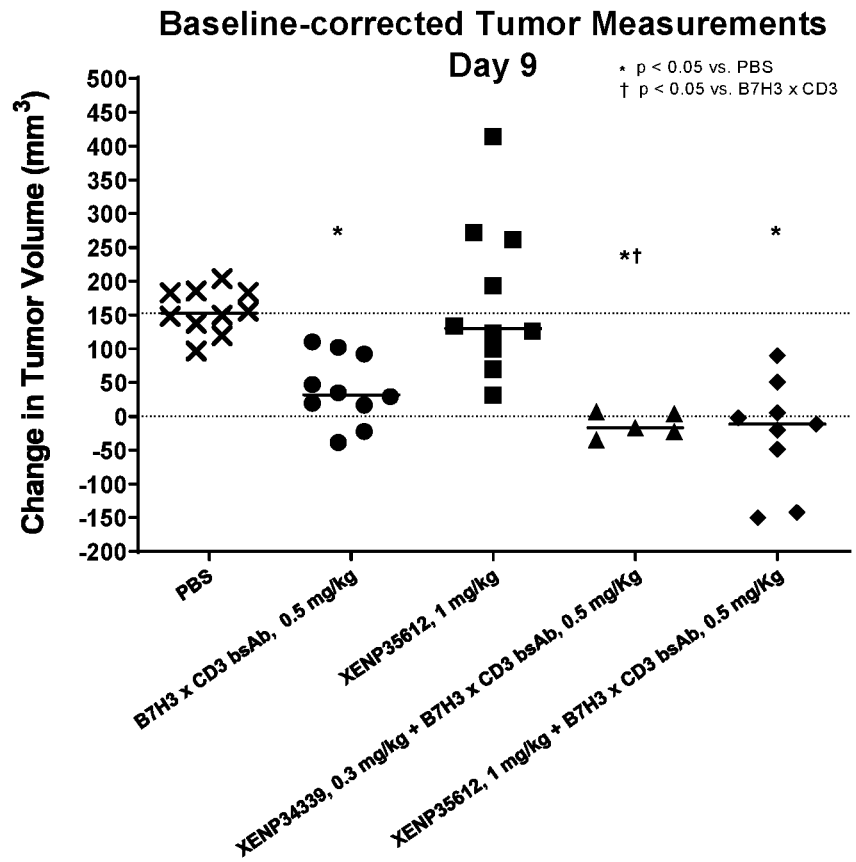

FIGS. 67A and 67B depict baseline corrected tumor volume on A) Day 6 and B) Day 9 (post-dose) in pp65-MDA-MB-231-engrafted CD34+ Hu-NSG mice dosed with a illustrative B7H3×CD3 bispecific antibody (0.5 mg/kg) alone, XENP35612 alone (1 mg/kg) alone, a combination of XENP34339 (0.3 mg/kg) with the B7H3×CD3 bsAb (0.5 mg/kg), a combination of XENP35612 (1 mg/kg) with the B7H3×CD3 bsAb (0.5 mg/kg), or PBS control. Statistics performed on baseline corrected data using Mann-Whitney test.

Figure 68A:
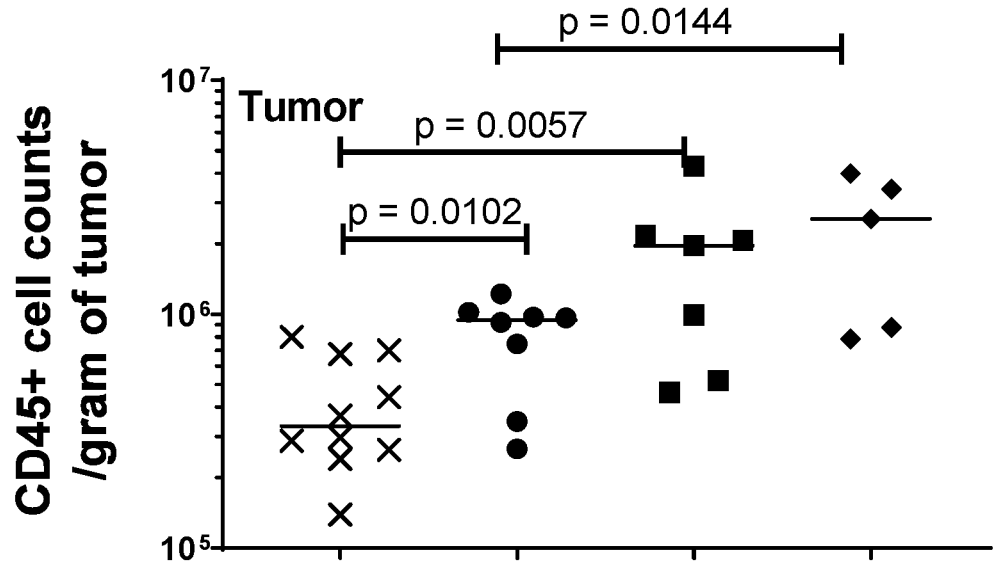
Figure 68B:
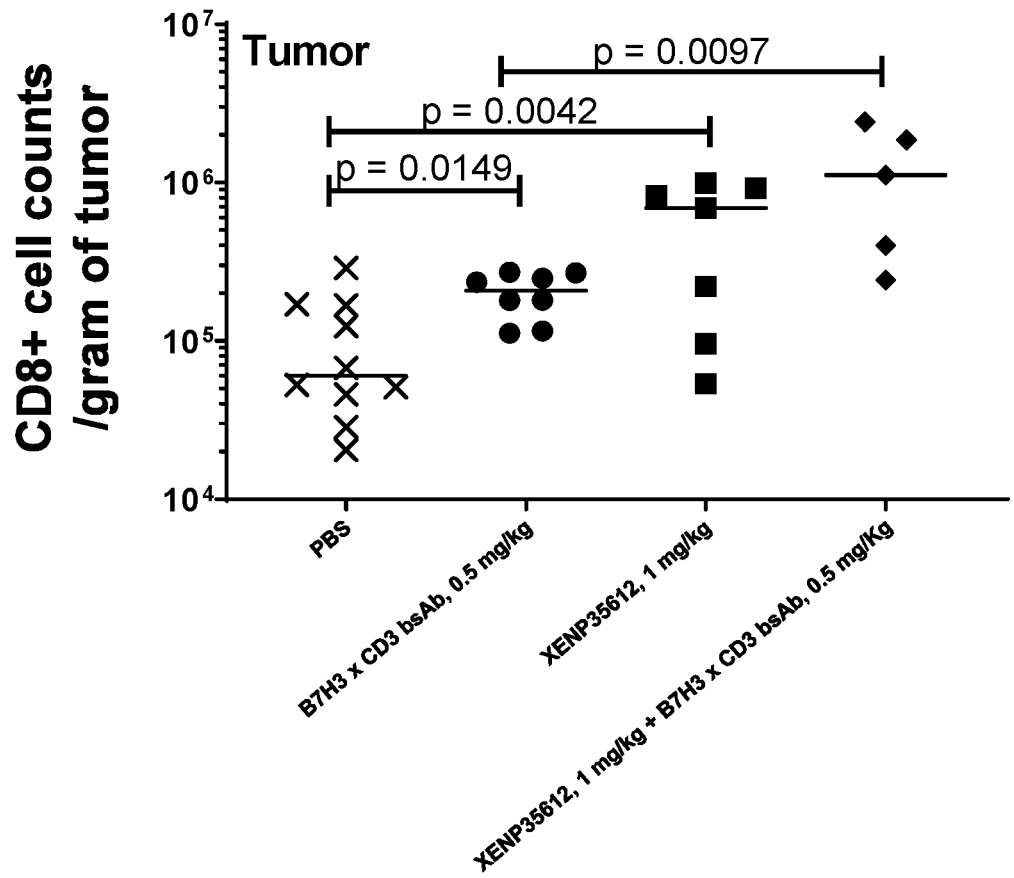

FIGS. 68A and 68B depict expansion of A) CD45+ and B) CD8+ cells in tumor of pp65-MDA-MB-231-engrafted CD34+ Hu-NSG mice dosed with an illustrative B7H3×CD3 bispecific antibody (0.5 mg/kg) alone, XENP35612 alone (1 mg/kg) alone, a combination of XENP35612 (1 mg/kg) with the B7H3×CD3 bsAb (0.5 mg/kg), or PBS control. Statistics performed on log-transformed data using unpaired t-test.

FIG. 69 depicts the sequences for XENP29154, which is in-house produced TGN1412.

Figure 70A:
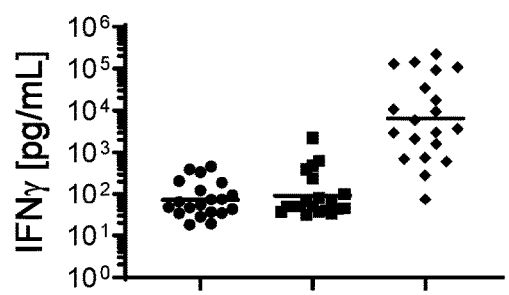
Figure 70B:
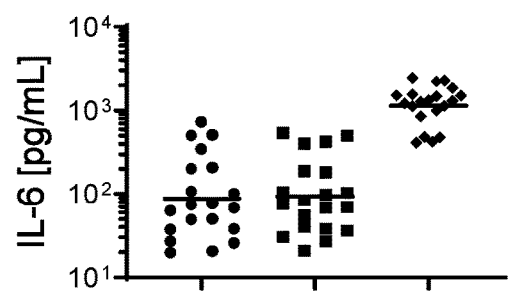
Figure 70C:
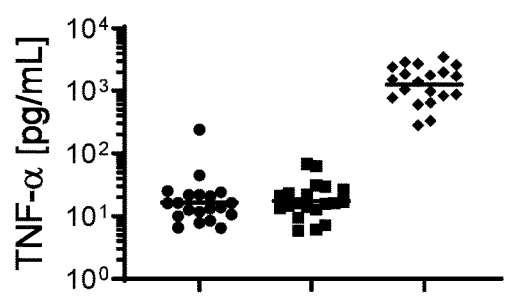

FIGS. 70A-70C depict the release of A) IFNγ, B) IL-6, and C) TNFα from human PBMCs treated with air-dried XENP34339, TGN1412 (XENP29154), or negative control PBS.

Figure 71A:
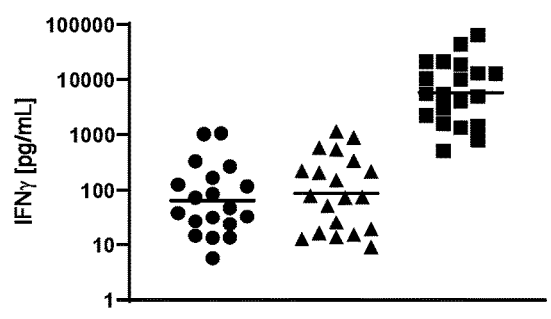
Figure 71B:
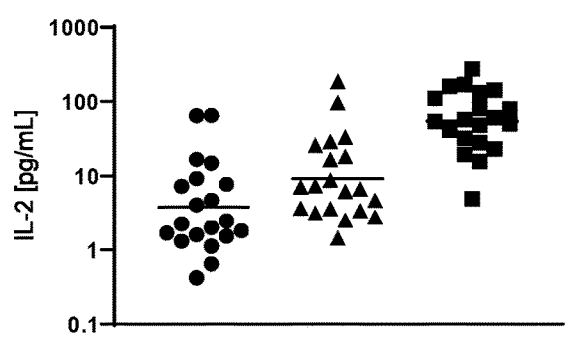
Figure 71C:
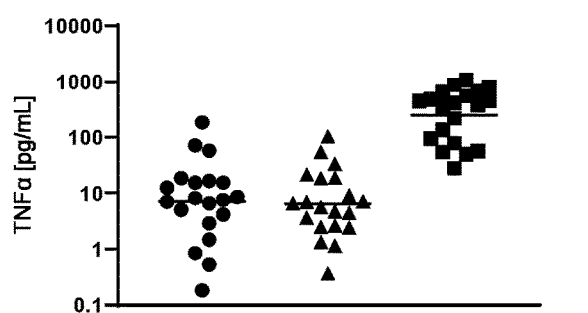

FIGS. 71A-71C depict the release of A) IFNγ, B) IL-2, and C) TNFα from human PBMCs treated with air-dried XENP37808, TGN1412 (XENP29154), or negative control PBS.

Figure 72A:
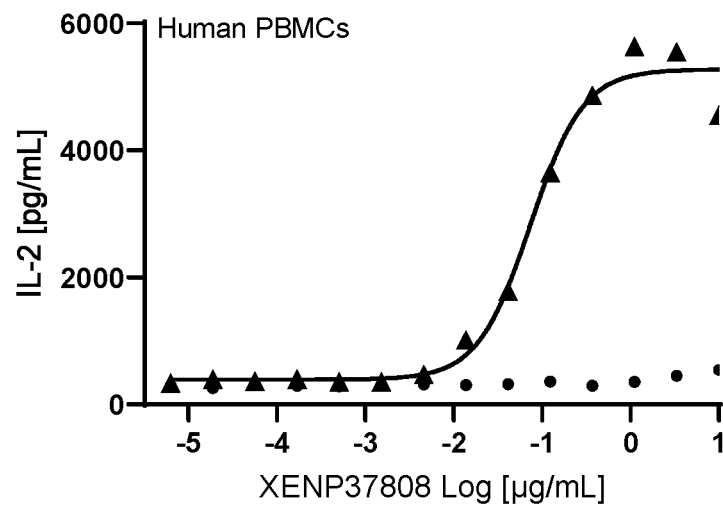
Figure 72B:
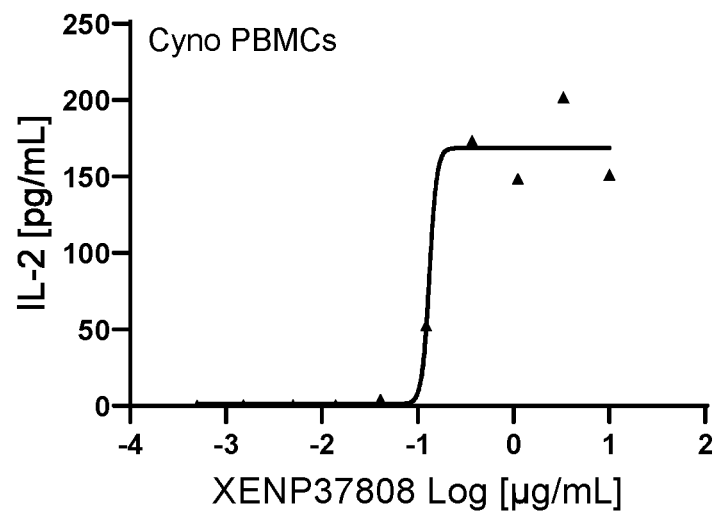

FIGS. 72A and 72B depict induction of IL-2 release by A) PBMCs from a human donor or B) PBMCs from a cynomolgus donor by XENP37808 in the presence of HEK cells transfected with αCD3 scFv (with or without B7H3 knock-out).

Figure 73A:
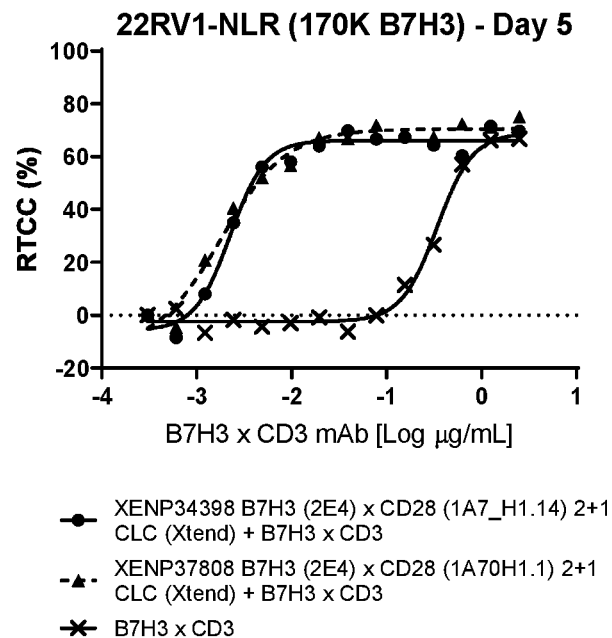
Figure 73B:
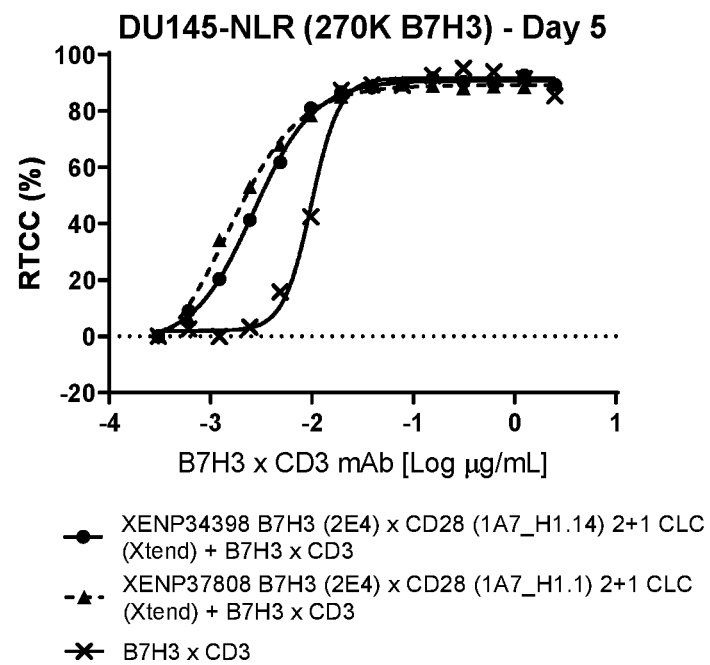

FIGS. 73A and 73B depict induction of RTCC on A) 22RV-NLR (having ~170K B7H3 antigen density) and B) DU145-NLR (having ~270K B7H3 antigen density) target cells B7H33×CD3 mAb alone, or in combination with either XENP34398 or XENP37808. The data show that XENP34398 and XENP37808 (in combination with B7H3 X CD3) induce very similar levels of RTCC.

Figure 74A:
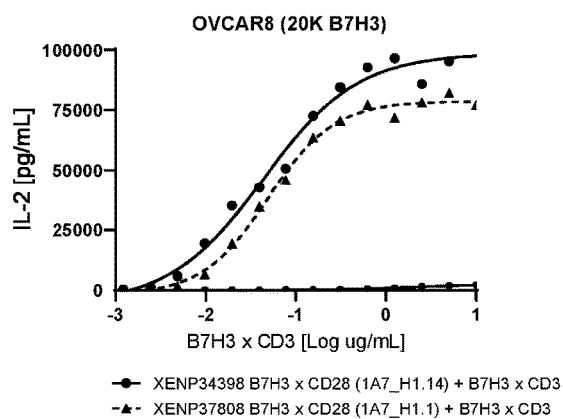
Figure 74B:
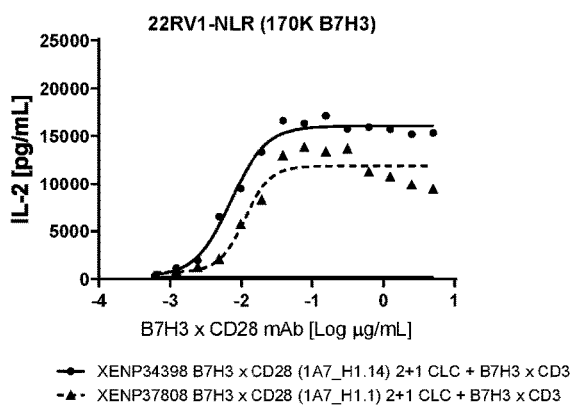
Figure 74C:
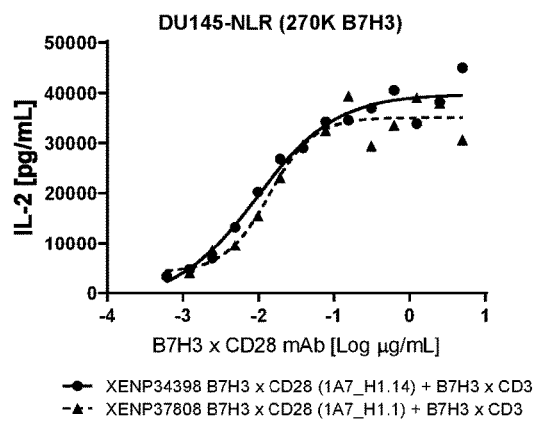

FIGS. 74A-74C depict induction of IL-2 release by T cells in the presence of A) OVCAR8 (having ~20K B7H3 antigen density), B) 22RV1-NLR (having ~170K B7H3 antigen density), and C) DU145-NLR (having ~270K B7H3 antigen density), and XENP34398 or XENP37808 in combination with a B7H3×CD3 bsAb.

FIG. 75 depicts consensus framework regions (FR) and complementarity determining regions (CDRs) (as in Kabat) for anti-B7H3 clone 2E4A3.189 variable heavy and variable light domain variants.

DETAILED DESCRIPTION

I. Overview

The activation of T cells in the treatment of cancer is being widely investigated. T cells require multiple signals for complete activation and differentiation. As shown in FIG. 40, Signal 1, promoted by recognition of a peptide-MHC (pMHC) complex by the T cell receptor (TCR), is absolutely required for T cell activation. Signal 2, which synergizes with, and amplifies signal 1, is typically provided by the interaction of the CD28 ligands CD80 and CD86 with CD28 itself. Although CD28 engagement alone is typically inert, when combined with signal 1 activation, it promotes additional activation, survival, and proliferative signals, including IL2 secretion. As CD80 and CD86 are only naturally expressed by professional antigen-presenting cells (APC), the extent of CD28 costimulation in the tumor setting can be highly variable. Accordingly, the present invention is directed to a novel class of tumor-targeted CD28 bispecific antibodies (including B7H3×CD28 more fully described herein), the CD80/CD86 engagement of CD28 can be mimicked, providing an artificial source of signal 2. Notably, signal can either be provided by the natural TCR: pMHC recognition of tumor cells, or it can be provided by combination of the CD28 bispecific with a CD3 bispecific (which can mimick signal 1).

Accordingly, provided herein are novel anti-CD28×anti-B7H3 (also referred to as "αCD28×αB7H3" and sometimes "CD28×B7H3") bispecific antibodies and methods of using such antibodies for the treatment of cancers. In many cases, these bispecific antibodies are heterodimeric. Subject αCD28×αB7H3 antibodies are capable of agonistically binding to CD28 costimulatory molecules on T cells and targeting to B7H3 on tumor cells. Thus, such antibodies selectively enhance anti-tumor activity at tumor sites while minimizing peripheral toxicity. The subject antibodies provided herein are particularly useful for enhancing anti-tumor activity either alone, as a monotherapy, or when used in combination with other anti-cancer therapies as more fully described herein Accordingly, in one aspect, provided herein are heterodimeric antibodies that bind to two different antigens, e.g., the antibodies are "bispecific," in that they bind two different target antigens, generally CD28 and B7H3 as described below. These heterodimeric antibodies can bind each of the target antigens either monovalently (e.g., there is a single antigen binding domain such as a variable heavy and variable light domain pair) or bivalently (there are two antigen binding domains that each independently bind the antigen). In some embodiments, the heterodimeric antibody provided herein includes one CD28 binding domain and one B7H3 binding domain (e.g., heterodimeric antibodies in the "1+1 Fab-scFv-Fc" format described herein, which are thus bispecific and bivalent). In other embodiments, the heterodimeric antibody provided herein includes one CD28 binding domain and two B7H3 binding domains (e.g., heterodimeric antibodies in the "2+1 Fab$_2$-scFv-Fc" formats described herein, which are thus bispecific but trivalent, as they contain three antigen binding domains (ABDs)). The heterodimeric antibodies provided herein are based on the use of different monomers that contain amino acid substitutions (i.e., skew variants") that "skew" formation of heterodimers over homodimers, as is more fully outlined below. In some embodiments, the heterodimer antibodies are also coupled with "pI variants" that allow simple purification of the heterodimers away from the homodimers, as is similarly outlined below. The heterodimeric bispecific antibodies provided generally rely on the use of engineered or variant Fc domains that can self-assemble in production cells to produce heterodimeric proteins, and methods to generate and purify such heterodimeric proteins.

II. Nomenclature

The antibodies provided herein are listed in several different formats. In some instances, each monomer of a particular antibody is given a unique "XENP" number, although as will be appreciated in the art, a longer sequence might contain a shorter one. For example, a "scFv-Fc" monomer of a 1+1 Fab-scFv-Fc format antibody may have a first XENP number, while the scFv domain itself will have a different XENP number. Some molecules have three polypeptides, so the XENP number, with the components, is used as a name. Thus, the molecule XENP34389, which is in 2+1 Fab$_2$-scFv-Fc format, comprises three sequences (see FIG. 28A) a "Fab-Fc Heavy Chain" monomer; 2) a "Fab-scFv-Fc Heavy Chain" monomer; and 3) a "Light Chain" monomer or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab includes the full heavy chain sequence, the variable heavy domain sequence and the three CDRs of the variable heavy domain sequence, the full light chain sequence, a variable light domain sequence and the three CDRs of the variable light domain sequence. A Fab-scFv-Fc monomer includes a full-length sequence, a variable heavy domain sequence, 3 heavy CDR sequences, and an scFv sequence (include scFv variable heavy domain sequence, scFv variable light domain sequence and scFv linker). Note that some molecules herein with a scFv domain use a single charged scFv linker (+H), although others can be used. In addition, the naming nomenclature of particular antigen binding domains (e.g., B7H3 and CD28 binding domains) use a "Hx.xx_Ly.yy" type of format, with the numbers being unique identifiers to particular variable chain sequences. Thus, the variable domain of the Fab side of B7H3 binding domain 6A[B7H3] (e.g., FIG. 28A) is "H1_L1", which indicates that the variable heavy domain, H1, was combined with the light domain L1. In the case that these sequences are used as scFvs, the designation "H1_L1", indicates that the variable heavy domain, H1 is combined with the light domain, L1, and is in V$_H$-linker-V$_L$ orientation, from N- to C-terminus. This molecule with the identical sequences of the heavy and light variable domains but in the reverse order (V$_L$-linker-V$_H$ orientation, from N- to C-terminus) would be designated "L1_H1". Similarly, different constructs may "mix and match" the heavy and light chains as will be evident from the sequence listing and the figures.

Additionally, with regard to the sequence listing, SEQ ID NOs:1 to 88 correspond to antigen binding domains previously shown in FIG. 17 of U.S. Ser. No. 63/092,272; SEQ ID NOs: 89-496 correspond to antigen binding domains previously shown in FIG. 24 of U.S. Ser. No. 63/092,272. Additionally, SEQ ID NOs: 497 to 584 are all variant variable heavy domains of the 2E4A3.189[B7H3] parental antibody, all of which find use in the present invention as more fully outlined below. SEQ ID NOs:585 to 651 are all variant variable heavy domains of the 1A7[CD28] parental antibody, all of which find use in the present invention. SEQ ID NOs:652 to 756 are all variant variable light domains of the 1A7[CD28] parental antibody, all of which find use in the present invention.

III. Definitions

In order that the application may be more completely understood, several definitions are set forth below. Such definitions are meant to encompass grammatical equivalents.

By "CD28," "Cluster of Differentiation 28," and "Tp44" (e.g., Genebank Accession Numbers NP_001230006 (human), NP_001230007 (human), NP_006130 (human), and NP_031668 (mouse)) herein is meant a B7 receptor expressed on T cells that provides co-stimulatory signals required for T cell activation and survival. T cell stimulation through CD28 in addition to the T cell receptor (TCR) provides a potent signal for the production of various interleukins. CD28 is the receptor for CD80 (B7.1) and CD86 (B7.2) proteins. CD28 includes an intercellular domain with a YMNM motif critical for the recruitment of SH2-domain containing proteins, particularly PI3K. CD28 also includes two proline-rich motifs that are able to bind SH3-containing proteins. Exemplary CD28 sequences are depicted in FIG. 1. Unless otherwise noted, references to CD28 are to the human CD28 sequence.

By "B7H3," "B7-H3," "B7RP-2," "CD276," "Cluster of Differentiation 276," (e.g., Genebank Accession Numbers NP_001019907 (human), NP_001316557 (human), NP_001316558 (human), NP_079516 (human), and NP_598744 (mouse)) herein is meant a type-1 transmembrane protein that is a member of the B7 family possessing an ectodomain composed of a single IgV-IgC domain pair. B7H3 is an immune checkpoint molecule and is aberrantly overexpressed in many types of cancers. Exemplary B7H3 sequences are depicted in FIGS. 2A and B. Unless otherwise noted, references to B7H3 are to the human B7H3 sequence.

By "ablation" herein is meant a decrease or removal of activity. Thus, for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 5, which generally are added to both monomers.

By "ADCC" or "antibody dependent cell-mediated cytotoxicity" as used herein is meant the cell-mediated reaction, wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

As used herein, the term "antibody" is used generally. Antibodies provided herein can take on a number of formats as described herein, including traditional antibodies as well as antibody derivatives, fragments and mimetics, described herein.

Traditional immunoglobulin (Ig) antibodies are "Y" shaped tetramers. Each tetramer is typically composed of two identical pairs of polypeptide chains, each pair having one "light chain" monomer (typically having a molecular weight of about 25 kDa) and one "heavy chain" monomer (typically having a molecular weight of about 50-70 kDa).

Other useful antibody formats include, but are not limited to, the "1+1 Fab-scFv-Fc," "2+1 Fab$_2$-scFv-Fc," "1+1 common light chain," and "2+1 common light chain" formats provided herein (see, e.g., FIG. 33). Additional useful antibody formats include, but are not limited to, "mAb-Fv," "mAb-scFv," "central-Fv", "one armed scFv-mAb," "scFv-mAb," "dual scFv," and "trident" format antibodies, as disclosed in US20180127501A1, which is incorporated by reference herein, particularly in pertinent part relating to antibody formats (see, e.g., FIG. 2 of US20180127501A1).

Antibody heavy chains typically include a variable heavy (VH) domain, which includes vhCDR1-3, and an Fc domain, which includes a CH2-CH3 monomer. In some embodiments, antibody heavy chains include a hinge and CH1 domain. Traditional antibody heavy chains are monomers that are organized, from N- to C-terminus: VH—CH1-hinge-CH2-CH3. The CH1-hinge-CH2-CH3 is collectively referred to as the heavy chain "constant domain" or "constant region" of the antibody, of which there are five different categories or "isotypes": IgA, IgD, IgG, IgE and IgM.

In some embodiments, the antibodies provided herein include IgG isotype constant domains, which has several subclasses, including, but not limited to IgG1, IgG2, IgG3, and IgG4. In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

It should be noted that IgG1 has different allotypes with polymorphisms at 356 (D or E) and 358 (L or M). The sequences depicted herein use the 356E/358M allotype, however the other allotype is included herein. That is, any sequence inclusive of an IgG1 Fc domain included herein can have 356D/358L replacing the 356E/358M allotype. It should be understood that therapeutic antibodies can also comprise hybrids of isotypes and/or subclasses. For example, as shown in US Publication 2009/0163699, incorporated by reference, the present antibodies, in some embodiments, include human IgG1/G2 hybrids.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgG1, IgG2, IgG3 or IgG4, with IgG1 hinge-CH2-CH3 and IgG4 hinge-CH2-CH3 finding particular use in many embodiments. Additionally, in the case of human IgG1 Fc domains, the hinge may include a C220S amino acid substitution. Furthermore, in the case of human IgG4 Fc domains, the hinge may include a S228P amino acid substitution. Although the boundaries of the Fc region may vary, the human IgG heavy chain Fc region is usually defined to include residues E216, C226, or A231 to its carboxyl-terminal, wherein the numbering is according to the EU index as in Kabat. In some embodiments, as is more fully described below, amino acid modifications are made to the Fc region, for example to alter binding to one or more FcγR or to the FcRn.

By "heavy chain constant region" herein is meant the CH1-hinge-CH2-CH3 portion of an antibody (or fragments thereof), excluding the variable heavy domain; in EU numbering of human IgG1 this is amino acids 118-447. By "heavy chain constant region fragment" herein is meant a heavy chain constant region that contains fewer amino acids from either or both of the N- and C-termini but still retains the ability to form a dimer with another heavy chain constant region.

Another type of domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well. Many of the antibodies herein have at least one the cysteines at position 220 according to EU numbering (hinge region) replaced by a serine. Generally, this modification is on the "scFv monomer" side (when 1+1 or 2+1 formats are used) for most of the sequences depicted herein, although it can also be on the "Fab monomer" side, or both, to reduce disulfide formation. Specifically included within the sequences herein are one or both of these cysteines replaced (C220S).

As will be appreciated by those in the art, the exact numbering and placement of the heavy chain constant region domains (i.e., CH1, hinge, CH2 and CH3 domains) can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
|---|---|---|
| CH1 | 118-215 | 114-223 |
| Hinge | 216-230 | 226-243 |
| CH2 | 231-340 | 244-360 |
| CH3 | 341-447 | 361-478 |

The antibody light chain generally comprises two domains: the variable light domain (VL), which includes light chain CDRs vlCDR1-3, and a constant light chain region (often referred to as CL or CK). The antibody light chain is typically organized from N- to C-terminus: VL-CL.

By "antigen binding domain" or "ABD" herein is meant a set of six Complementary Determining Regions (CDRs) that, when present as part of a polypeptide sequence, specifically binds a target antigen (e.g., B7H3 or CD28) as discussed herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 variable heavy CDRs and vlCDR1, vlCDR2 and vlCDR3 vhCDR3 variable light CDRs. The CDRs are present in the variable heavy domain (vhCDR1-3) and variable light domain (vlCDR1-3). The variable heavy domain and variable light domain from an Fv region.

The present invention provides a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g., vhCDR1, vhCDR2 and vhCDR3) and the disclosure of each variable light region is a disclosure of the vlCDRs (e.g., vlCDR1, vlCDR2 and vlCDR3). A useful comparison of CDR numbering is as below, see Lafranc et al., *Dev. Comp. Immunol.* 27(1):55-77 (2003):

TABLE 2

|  | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

The CDRs contribute to the formation of the antigen-binding, or more specifically, epitope binding site of the antigen binding domains and antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

In some embodiments, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used. In general, the C-terminus of the scFv domain is attached to the N-terminus of all or part of the hinge in the second monomer.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (vhCDR1, vhCDR2 and vhCDR3 for the variable heavy domain and vlCDR1, vlCDR2 and vlCDR3 for the variable light domain) and four framework (FR) regions, arranged from amino-terminus to carboxy-terminus in the following order: FR1-CDR1-FR2-CDR2-FR3-CDR3-FR4.

By "Fab" or "Fab region" as used herein is meant the antibody region that comprises the VH, CH1, VL, and CL immunoglobulin domains, generally on two different polypeptide chains (e.g., VH—CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant the antibody region that comprises the $V_L$ and $V_H$ domains. Fv regions can be formatted as both Fabs (as discussed above, generally two different polypeptides that also include the constant regions as outlined above) and single chain Fvs (scFvs), where the v and vh domains are included in a single peptide, attached generally with a linker as discussed herein.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In the sequences depicted in the sequence listing and in the figures, the order of the vh and vl domain is indicated in the name, e.g., H.X_L.Y means N- to C-terminal is vh-linker-vl, and L.Y_H.X is vl-linker-vh.

Some embodiments of the subject antibodies provided herein comprise at least one scFv domain, which, while not naturally occurring, generally includes a variable heavy domain and a variable light domain, linked together by a scFv linker. As outlined herein, while the scFv domain is generally from N- to C-terminus oriented as VH-scFv linker-VL, this can be reversed for any of the scFv domains (or those constructed using vh and vl sequences from Fabs), to VL-scFv linker-VH, with optional linkers at one or both ends depending on the format.

By "modification" or "variant" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution;" that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233 #, E233( ) or E233del designates a deletion of glutamic acid at position 233. Additionally, EDA233- or EDA233 # designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST.

"Variant" as used herein also refers to particular amino acid modifications that confer particular function (e.g., a "heterodimerization variant," "pI variant," "ablation variant," etc.).

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

"Fc variant" or "variant Fc" as used herein is meant a protein comprising an amino acid modification in an Fc domain. The modification can be an addition, deletion, or substitution. The Fc variants are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428/434S. It is noted that the order in which substitutions are provided is arbitrary, that is to say that, for example, 428L/434S is the same Fc variant as 434S/428L, and so on. For all positions discussed herein that relate to antibodies or derivatives and fragments thereof (e.g., Fc domains), unless otherwise noted, amino acid position numbering is according to the EU index. The "EU index" or "EU index as in Kabat" or "EU numbering" scheme refers to the numbering of the EU antibody (Edelman et al., 1969, Proc Natl Acad Sci USA 63:78-85, hereby entirely incorporated by reference). The modification can be an addition, deletion, or substitution.

In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains described herein still retain the ability to form a dimer with another Fc domain as measured using known techniques as described herein, such as non-denaturing gel electrophoresis.

By "protein" as used herein is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is an amino acid modification that contributes to increased binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "position" as used herein is meant a location in the sequence of a protein. Positions may be numbered sequentially, or according to an established format, for example the EU index for numbering of antibody domains (e.g., a CH1, CH2, CH3 or hinge domain).

By "target antigen" as used herein is meant the molecule that is bound specifically by the antigen binding domain comprising the variable regions of a given antibody.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the invention herein is meant a cell that contains the exogeneous nucleic acids encoding the components of the bispecific antibody and is capable of expressing the bispecific antibody under suitable conditions. Suitable host cells are discussed below.

By "wild type" or "WT" herein is meant an amino acid sequence or a nucleotide sequence that is found in nature, including allelic variations. A WT protein has an amino acid sequence or a nucleotide sequence that has not been intentionally modified.

Provided herein are a number of antibody domains (e.g., Fc domains) that have sequence identity to human antibody domains. Sequence identity between two similar sequences (e.g., antibody variable domains) can be measured by algorithms such as that of Smith, T. F. & Waterman, M.S. (1981) "Comparison Of Biosequences," Adv. Appl. Math. 2:482 [local homology algorithm]; Needleman, S. B. & Wunsch, CD. (1970) "A General Method Applicable To The Search For Similarities In The Amino Acid Sequence Of Two Proteins," J. Mol. Biol. 48:443 [homology alignment algorithm], Pearson, W.R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penalty, etc) are used. In one embodiment, sequence identity is done using the BLAST algorithm, using default parameters The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

IV. CD28 and B7H3 Antigen Binding Domains

Provided herein are antigen binding domains (ABDs) and ABD compositions that bind either B7H3 or CD28. In some embodiments, one or more of the ABDs are included in an antibody format described herein including, for example, "1+1 Fab-scFv-Fc," "2+1 Fab$_2$-scFv-Fc," "1+1 common light chain," and "2+1 common light chain" antibodies.

A. CD28 Antigen Binding Domains and Antibodies

In one aspect, provided herein are CD28 antigen binding domains (ABDs) that bind human CD28, and compositions that include such CD28 antigen binding domains (e.g., antibodies, including the heterodimeric antibodies provided herein). In some embodiments, the CD28 antigen binding domain described herein are agonistic CD28 ABDs that advantageously provide costimulatory activity. Thus, such CD28 ABDs provided herein are useful of enhancing immune responses, for example, when used as a monotherapy or in combination with other therapeutics (e.g., anti-cancer therapeutics for the treatment of particular cancers).

As will be appreciated by those in the art, suitable CD28 binding domains can comprise a set of 6 CDRs as depicted in the Sequence Listing and figures, either as they are underlined or, in the case where a different numbering scheme is used as described herein and as shown in Table 2, as the CDRs that are identified using other alignments within the variable heavy (VH) domain and variable light domain (VL) sequences of those depicted in FIGS. 18-21 and 23 and the Sequence Listing. Suitable CD28 ABDs can also include the entire VH and VL sequences as depicted in these sequences and figures, used as scFvs or as Fabs.

In one embodiment, the CD28 antigen binding domain includes the 6 CDRs (i.e., vhCDR1-3 and vlCDR1-3) of any of the CD28 binding domains described herein, including the figures and sequence listing. In some embodiments, the CD28 ABD that binds human CD28 is one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and the Sequence Listing). In exemplary embodiments, the CD28 ABD is CD28 ABDs: 1A7[CD28]_H1L1 or 1A7[CD28]_H1.14L1.

In addition to the parental CDR sets disclosed in the figures and sequence listing that form an ABD to CD28, provided herein are variant CD28 ABDS having CDRs that include at least one modification of the CD28 ABD CDRs disclosed herein (e.g., FIGS. 18-21 and 23 and the Sequence Listing). In one embodiment, the CD28 ABD includes a set of 6 CDRs with 1, 2, 3, 4, 5, 6, 7, 8, 9, 10 amino acid modifications as compared to the 6 CDRs of a CD28 ABD as described herein, including the figures and sequence listing. In exemplary embodiments, the CD28 ABD includes a set of 6 CDRs with 1, 2, 3, 4, 5, 6, 7, 8, 9, 10 amino acid modifications as compared to the 6 CDRs of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In exemplary embodiments, the CD28 ABD is CD28 ABDs: 1A7[CD28]_H1L1 or 1A7[CD28]_H1.14L1.

In certain embodiments, the CD28 ABD is capable of binding CD28 antigen, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In some embodiments, the CD28 ABD includes 6 CDRs that are at least 90, 95, 97, 98 or 99% identical to the 6 CDRs of a CD28 ABD as described herein, including the figures and sequence listing. In exemplary embodiments, the CD28 ABD includes 6 CDRs that are at least 90, 95, 97, 98 or 99% identical to the 6 CDRs of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In certain embodiments, the CD28 ABD is capable of binding to the CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In another exemplary embodiment, the CD28 ABD include the variable heavy (VH) domain and variable light (VL) domain of any one of the CD28 ABDs described herein, including the figures and sequence listing. In exemplary embodiments, the CD28 ABD is one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing).

In addition to the parental CD28 variable heavy and variable light domains disclosed herein, provided herein are CD28 ABDs that include a variable heavy domain and/or a variable light domain that are variants of a CD28 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a CD28 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In certain embodiments, the CD28 ABD is capable of binding to CD28, as measured at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In one embodiment, the variant VH and/or VL domain is at least 90, 95, 97, 98 or 99% identical to the VH and/or VL of a CD28 ABD as described herein, including the figures and sequence listing. In exemplary embodiments, the variant VH and/or VL domain is at least 90, 95, 97, 98 or 99% identical to the VH and/or VL of one of the following CD28 ABDs: 1A7[CD28]_H1L1, 1A7[CD28]_H1.14L1, 1A7 [CD28]_H1_L1.71, 1A7[CD28]_H1.1_L1.71, 1A7[CD28]_ H1.14_L1.71, CD28.3[CD28]_H0L0, hCD28.3[CD28]_ H1L1, 5.11A1[CD28]_H0L0, TGN1412_H1L1, 341VL34 [CD28]_H1L1, 341VL36[CD28]_H1L1, 281VL4[CD28]_ H1L1, HuTN228[CD28]_H1L1, PV1[CD28]_H0L0, m9.3 [CD28]_H0L0, and hu9.3[CD28]_H1L1 (FIGS. 18-21 and 23 and the Sequence Listing). In certain embodiments, the CD28 ABD is capable of binding to CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In one embodiment, the CD28 antigen binding domain includes a variable heavy domain ($V_H$) having the vhCDR1-3 (i.e., vhCDR1-3) of 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding CD28 antigen, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 Fab₂-scFv-Fc," "1+1 common light chain," and "2+1 common light chain" antibodies.

In one embodiment, the CD28 ABD includes a variable heavy domain ($V_H$) having vhCDR1-3s with 1, 2, 3, 4, 5, 6, 7, 8, 9, 10 amino acid modifications as compared to the vhCDR1-3 of 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding CD28 antigen, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 Fab₂-scFv-Fc," "1+1 common light chain," and "2+1 common light chain" antibodies.

In some embodiments, the CD28 ABD includes a variable heavy domain ($V_H$) having vhCDR1-3s that are at least 90, 95, 97, 98 or 99% identical to the 6 vhCDR1-3 of 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to the CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 Fab₂-scFv-Fc," "1+1 common light chain," and "2+1 common light chain" antibodies.

In another exemplary embodiment, the CD28 ABD include the variable heavy ($V_H$) domain 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to the CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 Fab₂-scFv-Fc," "1+1 common light chain," and "2+1 common light chain" antibodies.

In addition to the parental CD28 variable heavy domains disclosed herein, provided herein are CD28 ABDs that include a variable heavy domain that is a variant of 1A7_H1.14 (FIG. 16). In one embodiment, the variant VH domain has from 1, 2, 3, 4, 5, 6, 7, 8, 9 or 10 amino acid changes from 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to CD28, as measured at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 Fab₂-scFv-Fc," "1+1 common light chain," and "2+1 common light chain" antibodies.

In one embodiment, the variant VH domain is at least 90, 95, 97, 98 or 99% identical to 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 Fab₂-scFv-Fc," "1+1 common light chain," and "2+1 common light chain" antibodies.

Specific anti-CD28 ABDs of interest include a VH domain with an amino acid sequence selected from the group consisting of SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO: 1198 and SEQ ID NO: 1199, paired with a VL domain of SEQ ID NO:874.

In other cases, the anti-CD28 VH domain has an amino acid sequence selected from SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:1198 and SEQ ID NO:1199, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some cases, the anti-CD28 binding domain has a VH domain and VL domain with amino acid sequences selected from the pairs of a) SEQ ID NOs:1 and 5, b) SEQ ID NOs: 9 and 13, c) SEQ ID NOs:17 and 21, d) SEQ ID NOs:25 and 29, e) SEQ ID NOs:33 and 37, f) SEQ ID NOs:41 and 45; g) SEQ ID NOs:49 and 53, h) SEQ ID NOs:57 and 61, i) SEQ ID NOs:65 and 69, j) SEQ ID NOs:73 and 77, and k) SEQ ID NOs:81 and 85.

B. B7H3 Antigen Binding Domains

In one aspect, provided herein are B7H3 antigen binding domains (ABDs) and compositions that include such B7H3 antigen binding domains (ABDs), including anti-B7H3 antibodies. Such B7H3 binding domains and related antibodies (e.g., anti-B7H3×anti-CD28 bispecific antibodies) find use, for example, in the treatment of B7H3 associated cancers.

As will be appreciated by those in the art, suitable B7H3 binding domains can comprise a set of 6 CDRs as depicted in the Sequence Listing and FIGS. 26-31, either as the CDRs are underlined or, in the case where a different numbering scheme is used as described herein and as shown in Table 2, as the CDRs that are identified using other alignments within the variable heavy ($V_H$) domain and variable light domain ($V_L$) sequences of those depicted in FIGS. 26-31 and the Sequence Listing (see Table 2). Suitable B7H3 ABDs can also include the entire VH and VL sequences as depicted in these sequences and figures, used as scFvs or as Fab domains.

In one embodiment, the B7H3 antigen binding domain includes the 6 CDRs (i.e., vhCDR1-3 and vlCDR1-3) of a B7H3 ABD described herein, including the figures and sequence listing. In exemplary embodiments, the B7H3 ABD is one of the following B7H3 ABDs: 2E4A3.189 [B7H3]_H1L1, 2E4A3.189[B7H3]_H1/1A7[CD28]_L1, 2E4A3.189[B7H3]_H1.22L1, 2E4A3.189[B7H3]_H1.22/ 1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing).

In addition to the parental CDR sets disclosed in the figures and sequence listing that form an ABD to B7H3, provided herein are variant B7H3 ABDS having CDRs that include at least one modification of the B7H3 ABD CDRs disclosed herein. In one embodiment, the B7H3 ABD includes a set of 6 CDRs with 1, 2, 3, 4, 5, 6, 7, 8, 9, 10 amino acid modifications as compared to the 6 CDRs of a B7H3 ABD described herein, including the figures and sequence listing. In exemplary embodiments, the B7H3 ABD includes a set of 6 CDRs with 1, 2, 3, 4, 5, 6, 7, 8, 9, 10 amino acid modifications as compared to the 6 CDRs of one of the following B7H3 ABDs: 2E4A3.189[B7H3]_

H1L1, 2E4A3.189[B7H3]_H1/1A7[CD28]_L1, 2E4A3.189 [B7H3]_H1.22L1, 2E4A3.189[B7H3]_H1.22/1A7[CD28]_ L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the variant B7H3 ABD is capable of binding B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In one embodiment, the B7H3 ABD includes 6 CDRs that are at least 90, 95, 97, 98 or 99% identical to the 6 CDRs of a B7H3 ABD as described herein, including the figures and sequence listing. In exemplary embodiments, the B7H3 ABD includes 6 CDRs that are at least 90, 95, 97, 98 or 99% identical to the 6 CDRs of one of the following B7H3 ABDs: 2E4A3.189[B7H3]_H1L1, 2E4A3.189[B7H3]_H1/1A7 [CD28]_L1, 2E4A3.189[B7H3]_H1.22L1, 2E4A3.189 [B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the B7H3 ABD is capable of binding to B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In another exemplary embodiment, the B7H3 ABD include the variable heavy ($V_H$) domain and variable light ($V_L$) domain of any one of the B7H3 ABDs described herein, including the figures and sequence listing. In exemplary embodiments, the B7H3 ABD is one of the following B7H3 ABDs: 2E4A3.189[B7H3]_H1L1, 2E4A3.189 [B7H3]_H1/1A7[CD28]_L1, 2E4A3.189[B7H3]_H1.22L1, 2E4A3.189[B7H3]_H1/1A7[CD28]_L1, 2E4A3.189 [B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In exemplary embodiments, the B7H3 ABD is one of the following: B7H3 ABDs: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1/1A7[CD28]_L1, 2E4A3.189[B7H3]_H1.22/1A7[CD28]_L1, or 6A1 [B7H3]_H1L1.

In addition to the parental B7H3 variable heavy and variable light domains disclosed herein, provided herein are B7H3 ABDs that include a variable heavy domain and/or a variable light domain that are variants of a B7H3 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a B7H3 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following B7H3 ABDs: 2E4A3.189 [B7H3]_H1L1, 2E4A3.189[B7H3]_H1/1A7[CD28]_L1, 2E4A3.189[B7H3]_H1.22L1, 2E4A3.189[B7H3]_H1.22/ 1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the B7H3 ABD is capable of binding to B7H3, as measured at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In one embodiment, the variant VH and/or VL domain is at least 90, 95, 97, 98 or 99% identical to the VH and/or VL of a B7H3 ABD as described herein, including the figures and sequence listing. In exemplary embodiments, the variant VH and/or VL domain is at least 90, 95, 97, 98 or 99% identical to the VH and/or VL of one of the following B7H3 ABDs: 2E4A3.189[B7H3]_H1L1, 2E4A3.189[B7H3]_H1/ 1A7[CD28]_L1, 2E4A3.189[B7H3]_H1.22L1, 2E4A3.189 [B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the B7H3 ABD is capable of binding to the B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In one embodiment, the B7H3 antigen binding domain includes a variable heavy domain ($V_H$) having the vhCDR1-3 (i.e., vhCDR1-3) of 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 Fab$_2$-scFv-Fc," "1+1 common light chain," and "2+1 common light chain" antibodies.

In one embodiment, the B7H3 ABD includes a variable heavy domain (V$_H$) having vhCDR1-3s with 1, 2, 3, 4, 5, 6, 7, 8, 9, 10 amino acid modifications as compared to the vhCDR1-3 of 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 Fab$_2$-scFv-Fc," "1+1 common light chain," and "2+1 common light chain" antibodies.

In some embodiments, the B7H3 ABD includes a variable heavy domain (V$_H$) having vhCDR1-3s that are at least 90, 95, 97, 98 or 99% identical to the 6 vhCDR1-3 of 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189 L1 (FIG. 26), 1A7_L1 (FIG. 18) or a variant thereof. In certain embodiments, the B7H3 ABD is capable of binding to the B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 Fab$_2$-scFv-Fc," "1+1 common light chain," and "2+1 common light chain" antibodies.

In another exemplary embodiment, the B7H3 ABD include the variable heavy (V$_H$) domain 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to the B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 1). Such B7H3 binding domains can be included in any of the antibodies provided herein including, for example, "1+1 Fab-scFv-Fc," "2+1 Fab$_2$-scFv-Fc," "1+1 common light chain," and "2+1 common light chain" antibodies.

In addition to the parental B7H3 variable heavy domains disclosed herein, provided herein are B7H3 ABDs that include a variable heavy domain that is a variant of the variable heavy (V$_H$) domain 2E4A3.189_H1.22 (FIG. 27). In one embodiment, the variant VH domain has from 1, 2, 3, 4, 5, 6, 7, 8, 9 or 10 amino acid changes from the variable heavy (V$_H$) domain 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to B7H3, as measured at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 Fab$_2$-scFv-Fc," "1+1 common light chain," and "2+1 common light chain" antibodies.

In one embodiment, the variant VH domain is at least 90, 95, 97, 98 or 99% identical to 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 Fab$_2$-scFv-Fc," "1+1 common light chain," and "2+1 common light chain" antibodies.

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; l) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAb16; hh) SEQ ID NOs:353 and 357 from chAB10; ii) SEQ ID NOs:361 and 365 from ChAb7; jj) SEQ ID NOs: 369 and 373 from chAb8, kk) SEQ ID NOs:377 and 381 from chAb17; ll) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In some embodiments, the anti-B7H3 ABD has an VH domain with the amino acid sequence of SEQ ID NO:942 (2E4A3.189_H1.22) and a VL domain with the amino acid sequence of SEQ ID NO:874 (1A7[CD28]_L1, which is the common light chain for both B7H3 and CD28).

V. Antibodies

In one aspect provided herein are anti-CD28 antibodies and anti-B7H3 antibodies. Antibodies provided herein can include any of the B7H3 and/or CD28 binding domains provided herein (e.g., "1+1 Fab-scFv-Fc," "2+1 Fab$_2$-scFv-Fc," "1+1 common light chain," and "2+1 common light chain" antibodies).

The antibodies provided herein include different antibody domains. As described herein and known in the art, the antibodies described herein include different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

As shown herein, there are a number of suitable linkers (for use as either domain linkers or scFv linkers) that can be used to covalently attach the recited domains (e.g., scFvs, Fabs, Fc domains, etc.), including traditional peptide bonds, generated by recombinant techniques. Exemplary linkers to attach domains of the subject antibody to each other are depicted in FIG. 7. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n, (GGGGS)n, and (GGGS)n, where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of C/CH1 domain but not all residues of CL/CH1 domain; for example the first 5-12 amino acid residues of the C/CH1 domains. Linkers can be derived from immunoglobulin light chain, for example Cκ or Ck. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the linker is a "domain linker", used to link any two domains as outlined herein together. For example, in the 2+1 Fab$_2$-scFv-Fc format, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n, (GGGGS)n, and (GGGS)n, where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used. Exemplary useful domain linkers are depicted in FIG. 7.

In some embodiments, the linker is a scFv linker that is used to covalently attach the VH and VL domains as discussed herein. In many cases, the scFv linker is a charged scFv linker, a number of which are shown in FIG. 6. Accordingly, provided herein are charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make 1+1 Fab-scFv-Fc format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 6 can be used in any embodiment herein where a linker is utilized.

The B7H3 binding domains and CD28 binding domains provided can be included in any useful antibody format including, for example, canonical immunoglobulin, as well as the "1+1 Fab-scFv-Fc," "2+1 Fab$_2$-scFv-Fc," "1+1 common light chain," and "2+1 common light chain" formats provided herein (see, e.g., FIG. 25). Other useful antibody formats include, but are not limited to, "mAb-Fv," "mAb-scFv," "central-Fv", "one armed scFv-mAb," "scFv-mAb," "dual scFv," and "trident" format antibodies, as disclosed in US20180127501A1, which is incorporated by reference herein, particularly in pertinent part relating to antibody formats (see, e.g., FIG. 2).

In some embodiments, the subject antibody includes one or more of the B7H3 ABDs provided herein. In some embodiments, the antibody includes one B7H3 ABD. In other embodiments, the antibody includes two B7H3 ABDs. In exemplary embodiments, the B7H3 ABD includes the variable heavy domain and variable light domain of one of the following B7H3 ABDs: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_ L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In some embodiments, the B7H3 ABD is one of the following B7H3 ABDs: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_ L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In an exemplary embodiment, the antibody is a bispecific antibody that includes one or two B7H3 ABDs, including any of the B7H3 ABDs provided herein. Bispecific antibody that include such B7H3 ABDs include, for example, "1+1 Fab-scFv-Fc," "2+1 Fab$_2$-scFv-Fc," "1+1 common light chain," and "2+1 common light chain" bispecifics format antibodies (FIG. 25). In exemplary embodiments, the B7H3 ABD is one of the following B7H3 ABDs: 2E4A3.189 [B7H3]_H1L1, 2E4A3.189[B7H3]_H1/1A7[CD28]_L1, 2E4A3.189[B7H3]_H1.22L1, 2E4A3.189[B7H3]_H1.22/ 1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing). In exemplary embodiments the B7H3 binding domains is a Fab. In some embodiments, such bispecific antibodies are heterodimeric bispecific antibodies that include any of the heterodimerization skew variants, pI variants and/or ablation variants described herein. See FIG. 8.

In some embodiments, the subject antibody includes one or more of the CD28 ABDs provided herein. In some embodiments, the antibody includes one CD28 ABD. In other embodiments, the antibody includes two CD28 ABDs. In exemplary embodiments, the antibody includes the variable heavy domain and variable light domain of one of the CD28 ABDs: 1A7[CD28]_H1L1, 1A7[CD28]_H1.14L1, 1A7[CD28]_H1_L1.71, 1A7[CD28]_H1.1_L1.71, 1A7 [CD28]_H1.14_L1.71, CD28.3[CD28]_H0L0, hCD28.3 [CD28]_H1L1, 5.11A1[CD28]_H0L0, TGN1412_H1L1, 341VL34[CD28]_H1L1, 341VL36[CD28]_H1L1, 281VL4 [CD28]_H1L1, HuTN228[CD28]_H1L1, PV1[CD28]_ H0L0, m9.3[CD28]_H0L0, hu9.3[CD28]_H1L1 (FIGS. 18-21 and 23 and the Sequence Listing).

In an exemplary embodiment, the antibody is a bispecific antibody that includes one or two CD28 ABDs, including any of the CD28 ABDs provided herein. Bispecific antibody that include such CD28 ABDs include, for example, "1+1 Fab-scFv-Fc," "2+1 Fab$_2$-scFv-Fc," "1+1 common light chain," and "2+1 common light chain" bispecifics format antibodies (FIG. 25). In exemplary embodiments, the CD28 ABD is one of the following CD28 ABDs: 1A7[CD28]_ H1L1, 1A7[CD28]_H1.14L1, 1A7[CD28]_H1_L1.71, 1A7 [CD28]_H1.1_L1.71, 1A7[CD28]_H1.14_L1.71, CD28.3 [CD28]_H0L0, hCD28.3[CD28]_H1L1, 5.11A1[CD28]_ H0L0, TGN1412_H1L1, 341VL34[CD28]_H1L1, 341VL36[CD28]_H1L1, 281VL4[CD28]_H1L1, HuTN228 [CD28]_H1L1, PV1[CD28]_H0L0, m9.3[CD28]_H0L0, hu9.3[CD28]_H1L1 (FIGS. 18-21 and 23 and the Sequence Listing). In exemplary embodiments, the CD28 ABD is an anti-CD28 scFv included in an "1+1 Fab-scFv-Fc," or "2+1 Fab$_2$-scFv-Fc bispecifics format antibodies (FIG. 25). In some embodiments, such bispecific antibodies are heterodimeric bispecific antibodies that include any of the heterodimerization skew variants, pI variants and/or ablation variants described herein. See FIG. 8.

A. Chimeric and Humanized Antibodies

In certain embodiments, the subject antibodies provided herein include a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

B. Anti-CD28×Anti-Tumor Associated Antigen (TAA) Antibodies

In another aspect, provided herein are anti-CD28×anti-TAA antibodies. In some embodiments, the anti-CD28×anti-TAA antibody includes a CD28 binding and one or more binding domains that bind a tumor associated antigen. In some embodiments, the CD28 binding domain of the antibody is an agonistic CD28 binding domain that provides co-stimulatory function by binding to CD28 on T cells. As such, the anti-CD28×anti-TAA antibody provided herein enhance immune responses selectively at tumor sites that express the particular TAA (e.g., B7H3). In some embodiments, the anti-CD28×anti-TAA antibody is a bispecific antibody. In some embodiments, the anti-CD28×anti-TAA antibody is a trispecific antibody. In some embodiments, the anti-CD28×anti-TAA antibody is a bivalent antibody. In some embodiments, the anti-CD28×anti-TAA antibody is a trivalent antibody. In some embodiments, the anti-CD28×anti-TAA antibody is a bispecific, bivalent antibody. In exemplary embodiments, the anti-CD28×anti-TAA antibody is a bispecific, trivalent antibody.

As is more fully outlined herein, the anti-CD28×anti-TAA antibody can be in a variety of formats, as outlined below. Exemplary formats include the "1+1 Fab-scFv-Fc," "2+1 Fab$_2$-scFv-Fc," "1+1 common light chain," and "2+1 common light chain" formats provided herein (see, e.g., FIG. 25). Other useful antibody formats include, but are not limited to, "mAb-Fv," "mAb-scFv," "central-Fv", "one armed scFv-mAb," "scFv-mAb," "dual scFv," and "trident" format antibodies, as disclosed in US20180127501A1, which is incorporated by reference herein, particularly in pertinent part relating to antibody formats (see, e.g., FIG. 2).

The anti-CD28×anti-TAA antibody can include any suitable CD28 ABD, including those described herein. In some embodiments, the CD28 ABD is an agonistic ABD that provides co-stimulatory function upon binding to CD28. In some embodiments, the anti-CD28×anti-TAA antibody includes a CD28 binding domain that includes the variable heavy domain and variable light of one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and Sequence Listing) or variant thereof.

The anti-CD28×anti-TAA antibody provided herein can include one or more TAA binding domains. In some embodiments, the anti-CD28×anti-TAA antibody includes one TAA binding domain. In certain embodiments, the anti-CD28×anti-TAA antibody includes two TAA binding domain. Any suitable TAA binding domain can be included in the subject anti-CD28×anti-TAA antibody, depending on the tumor selected for targeting. TAAs that can be targeted by the anti-CD28×anti-TAA antibodies provided herein include, but are not limited to: B7H, CD20, CD38, CD123; ROR1, ROR2, BCMA; PSMA; SSTR2; SSTR5, CD19, FLT3, CD33, PSCA, ADAM 17, CEA, Her2, EGFR, EGFR-vIII, CD30, FOLR1, GD-2, CA-IX, Trop-2, CD70, CD38, mesothelin, EphA2, CD22, CD79b, GPNMB, CD56, CD138, CD52, CD74, CD30, CD123, RON, ERBB2, and EGFR. Additional TAAs are described for example, in US20160355608 and US20170209492, which are incorporated herein in pertinent parts relating to tumor-associated antigens. Suitable TAA binding domains that can be included in the subject anti-CD28×anti-TAA antibodies are disclosed, for example, US20190248898A1 (SSTR2), US20200165356A1 (FAP), US20170320947A1 (PSMA), which are all incorporated by reference in pertinent parts relating to TAA binding domains.

In certain embodiments, the anti-CD28×anti-TAA antibody includes a B7H3 binding domain. In some embodiments, such anti-CD28×anti-B7H3 (also referred to herein as "αB7H3ΔαCD28" or as "αCD28×αB7H3") bispecific antibodies include at least one B7H3 ABD and at least one CD28 binding domain. In exemplary embodiments, the anti-CD28×anti-B7H3 bispecific antibody includes two B7H3 binding domains. In some embodiments, the CD28 binding domain of the bispecific antibody is an agonistic CD28 binding domain that provides co-stimulatory function by binding to CD28 on T cells. As such, the bispecific αB7H3ΔαCD28 provided herein enhance immune responses selectively in tumor sites that express B7H3.

The anti-CD28×anti-B7H3 bispecific antibody can include any suitable CD28 ABD and B7H3 ABD, including those described herein. In some embodiments, the anti-CD28×anti-B7H3 bispecific antibody includes a CD28 binding domain that includes the variable heavy domain and variable light of one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing) or variant thereof. In some embodiments, the B7H3 ABD includes the variable heavy domain and variable light domain of one of the following B7H3 ABDs: 2E4A3.189[B7H3]_H1L1, 2E4A3.189[B7H3]_H1/1A7[CD28]_L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing) or variants thereof.

Note that unless specified herein, the order of the antigen list in the name does not confer structure; that is an anti-B7H3 X anti-CD28 1+1 Fab-scFv-Fc antibody can have the scFv bind to B7H3 or CD28, although in some cases, the order specifies structure as indicated.

In addition, in embodiments wherein the subject antibody includes an scFv, the scFv can be in an orientation from N- to C-terminus of $V_H$-scFv linker-VL or $V_L$-scFv linker-$V_H$. In some formats, one or more of the ABDs generally is a Fab that includes a VH domain on one protein chain (generally as a component of a heavy chain) and a VL on another protein chain (generally as a component of a light chain).

As will be appreciated by those in the art, any set of 6 CDRs or VH and VL domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 6.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g., from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g., there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

C. Heterodimeric Antibodies

In exemplary embodiments, the anti-CD28×anti-TAA (e.g., anti-CD28×anti-B7H3) antibodies provided herein are heterodimeric bispecific antibodies that include two variant Fc domain sequences. Such variant Fc domains include amino acid modifications to facilitate the self-assembly and/or purification of the heterodimeric antibodies.

An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in biasing the formation of the desired heterodimeric antibody over the formation of the homodimers and/or purifying the heterodimeric antibody away from the homodimers.

There are a number of mechanisms that can be used to generate the subject heterodimeric antibodies. In addition, as will be appreciated by those in the art, these different mechanisms can be combined to ensure high heterodimerization. Amino acid modifications that facilitate the production and purification of heterodimers are collectively referred to generally as "heterodimerization variants." As discussed below, heterodimerization variants include "skew" variants (e.g., the "knobs and holes" and the "charge pairs" variants described below) as well as "pI variants," which allow purification of heterodimers from homodimers. As is generally described in U.S. Pat. No. 9,605,084, hereby incorporated by reference in its entirety and specifically as below for the discussion of heterodimerization variants, useful mechanisms for heterodimerization include "knobs and holes" ("KIH") as described in U.S. Pat. No. 9,605,084, "electrostatic steering" or "charge pairs" as described in U.S. Pat. No. 9,605,084, pI variants as described in U.S. Pat. No. 9,605,084, and general additional Fc variants as outlined in U.S. Pat. No. 9,605,084 and below.

Heterodimerization variants that are useful for the formation and purification of the subject heterodimeric antibody (e.g., bispecific antibodies) are further discussed in detailed below.

1. Skew Variants

In some embodiments, the heterodimeric antibody includes skew variants which are one or more amino acid modifications in a first Fc domain (A) and/or a second Fc domain (B) that favor the formation of Fc heterodimers (Fc dimers that include the first and the second Fc domain; (A-B) over Fc homodimers (Fc dimers that include two of the first Fc domain or two of the second Fc domain; A-A or B-B). Suitable skew variants are included in the FIG. 29 of US Publ. App. No. 2016/0355608, hereby incorporated by reference in its entirety and specifically for its disclosure of skew variants, as well as in FIGS. 3 and 9.

One particular type of skew variants is generally referred to in the art as "knobs and holes," referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety and specifically for the disclosure of "knobs and holes" mutations. This is sometime referred to herein as "steric variants." The figures identify a number of "monomer A-monomer B" pairs that rely on "knobs and holes". In addition, as described in Merchant et al., Nature Biotech. 16:677 (1998), these "knobs and holes" mutations can be combined with disulfide bonds to further favor formation of Fc heterodimers.

Another method that finds use in the generation of heterodimers is sometimes referred to as "electrostatic steering" as described in Gunasekaran et al., J. Biol. Chem. 285(25): 19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, these are classified as "skew variants". These include, but are not limited to, D221E/P228E/L368E paired with D221R/P228R/K409R (e.g., these are "monomer corresponding sets) and C220E/P228E/368E paired with C220R/E224R/P228R/K409R.

In some embodiments, the skew variants advantageously and simultaneously favor heterodimerization based on both the "knobs and holes" mechanism as well as the "electrostatic steering" mechanism. In some embodiments, the heterodimeric antibody includes one or more sets of such heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other. That is, these pairs of sets may instead form an interface between the two monomers that encourages heterodimer formation and discourages homodimer formation, allowing the percentage of heterodimers that spontaneously form under biological conditions to be over 90%, rather than the expected 50% (25% homodimer A/A:50% heterodimer A/B:25% homodimer B/B). Exemplary heterodimerization "skew" variants are depicted in FIG. 4. In exemplary embodiments, the heterodimeric antibody includes a S364K/E357Q:L368D/K370S; L368D/K370S: S364K; L368E/K370S: S364K; T411T/E360E/Q362E: D401K; L368D/K370S: S364K/E357L; K370S: S364K/E357Q; or a T366S/L368A/Y407V: T366W (optionally including a bridging disulfide, T366S/L368A/Y407V/Y349C: T366W/S354C) "skew" variant amino acid substitution set. In an exemplary embodiment, the heterodimeric antibody includes a "S364K/E357Q: L368D/K370S" amino acid substitution set. In terms of nomenclature, the pair "S364K/E357Q:L368D/K370S" means that one of the monomers includes an Fc domain that includes the amino acid substitutions S364K and E357Q and the other monomer includes an Fc domain that includes the amino acid substitutions L368D and K370S; as above, the "strandedness" of these pairs depends on the starting pI.

In some embodiments, the skew variants provided herein can be optionally and independently incorporated with any other modifications, including, but not limited to, other skew variants (see, e.g., in FIG. 37 of US Publ. App. No. 2012/0149876, herein incorporated by reference, particularly for its disclosure of skew variants), pI variants, isotpypic variants, FcRn variants, ablation variants, etc. into one or both of the first and second Fc domains of the heterodimeric antibody. Further, individual modifications can also independently and optionally be included or excluded from the subject the heterodimeric antibody.

In some embodiments, the skew variants outlined herein can be optionally and independently incorporated with any pI variant (or other variants such as Fc variants, FcRn variants, etc.) into one or both heavy chain monomers, and can be independently and optionally included or excluded from the subject heterodimeric antibodies.

2. pI (Isoelectric point) Variants for Heterodimers

In some embodiments, the heterodimeric antibody includes purification variants that advantageously allow for the separation of heterodimeric antibody (e.g., anti-B7H3× anti-CD28 bispecific antibody) from homodimeric proteins.

There are several basic mechanisms that can lead to ease of purifying heterodimeric antibodies. For example, modifications to one or both of the antibody heavy chain monomers A and B such that each monomer has a different pI allows for the isoelectric purification of heterodimeric A-B antibody from monomeric A-A and B-B proteins. Alternatively, some scaffold formats, such as the "1+1 Fab-scFv-Fc" format, the "2+1 Fab₂-scFv-Fc" format, and the "2+1 CLC" format allows separation on the basis of size. As described above, it is also possible to "skew" the formation of heterodimers over homodimers using skew variants. Thus, a combination of heterodimerization skew variants and pI variants find particular use in the heterodimeric antibodies provided herein.

Additionally, as more fully outlined below, depending on the format of the heterodimeric antibody, pI variants either contained within the constant region and/or Fc domains of a monomer, and/or domain linkers can be used. In some embodiments, the heterodimeric antibody includes additional modifications for alternative functionalities that can also create pI changes, such as Fc, FcRn and KO variants.

In some embodiments, the subject heterodimeric antibodies provided herein include at least one monomer with one or more modifications that alter the pI of the monomer (i.e., a "pI variant"). In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Depending on the format of the heterodimer antibody, pI variants can be either contained within the constant and/or Fc domains of a monomer, or charged linkers, either domain linkers or scFv linkers, can be used. That is, antibody formats that utilize scFv(s) such as "1+1 Fab-scFv-Fc", format can include charged scFv linkers (either positive or negative), that give a further pI boost for purification purposes. As will be appreciated by those in the art, some 1+1 Fab-scFv-Fc and 2+1 Fab₂-scFv-Fc formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In subject heterodimeric antibodies that utilizes pI as a separation mechanism to allow the purification of heterodimeric proteins, amino acid variants are introduced into one or both of the monomer polypeptides. That is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (aspartic acid to lysine) or changing a charged residue to a neutral residue (e.g., loss of a charge; lysine to serine). A number of these variants are shown in the FIGS. 3 and 4.

Thus, in some embodiments, the subject heterodimeric antibody includes amino acid modifications in the constant regions that alter the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the 1+1 Fab-scFv-Fc, 2+1 Fab$_2$-scFv-Fc, 1+1 CLC and 2+1 CLC formats, the starting pI of the scFv (1+1 Fab-scFv-Fc, 2+1 Fab$_2$-scFv-Fc) and Fab(s) of interest. That is, to determine which monomer to engineer or in which "direction" (e.g., more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and pI heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g., the minimization or avoidance of non-human residues at any particular position. Alternatively or in addition to isotypic substitutions, the possibility of immunogenicity resulting from the pI variants is significantly reduced by utilizing isosteric substitutions (e.g. Asn to Asp; and Gln to Glu).

As discussed below, a side benefit that can occur with this pI engineering is also the extension of serum half-life and increased FcRn binding. That is, as described in US Publ. App. No. US 2012/0028304 (incorporated by reference in its entirety), lowering the pI of antibody constant domains (including those found in antibodies and Fc fusions) can lead to longer serum retention in vivo. These pI variants for increased serum half-life also facilitate pI changes for purification.

In addition, it should be noted that the pI variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

In general, embodiments of particular use rely on sets of variants that include skew variants, which encourage heterodimerization formation over homodimerization formation, coupled with pI variants, which increase the pI difference between the two monomers to facilitate purification of heterodimers away from homodimers.

Exemplary combinations of pI variants are shown in FIGS. 4 and 5, and FIG. 30 of US Publ. App. No. 2016/0355608, all of which are herein incorporated by reference in its entirety and specifically for the disclosure of pI variants. Preferred combinations of pI variants are shown in FIGS. 3 and 4. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO:796). However, as will be appreciated by those in the art, the first monomer includes a CH1 domain, including position 208. Accordingly, in constructs that do not include a CH1 domain (for example for antibodies that do not utilize a CH1 domain on one of the domains), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIG. 6).

In some embodiments, modifications are made in the hinge of the Fc domain, including positions 216, 217, 218, 219, 220, 221, 222, 223, 224, 225, 226, 227, 228, 229, and 230 based on EU numbering. Thus, pI mutations and particularly substitutions can be made in one or more of positions 216-230, with 1, 2, 3, 4 or 5 mutations finding use. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339, based on EU numbering. It should be noted that changes in 233-236 can be made to increase effector function (along with 327A) in the IgG2 backbone. Again, all possible combinations of these 14 positions can be made; e.g., an anti-CD28 or anti-B7H3 antibody provided herein may include a variant Fc domain with 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the modifications can be independently and optionally selected from position 355, 359, 362, 384, 389, 392, 397, 418, 419, 444 and 447 (EU numbering)

of the CH3 region. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

3. Isotypic Variants

In addition, many embodiments of the subject heterodimeric antibodies rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

4. Calculating pI

The pI of each monomer of the antibodies provided herein can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

5. pI Variants that Also Confer Better FcRn In Vivo Binding

In the case where the pI variant decreases the pI of the monomer, the pI variant can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half-life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

D. Additional Fc Variants for Additional Functionality

In addition to the heterodimerization variants discussed above, there are a number of useful Fc amino acid modification that can be made for a variety of reasons, including, but not limited to, altering binding to one or more FcγR receptors, altered binding to FcRn receptors, etc, as discussed below.

Accordingly, the antibodies provided herein (heterodimeric, as well as homodimeric) can include such amino acid modifications with or without the heterodimerization variants outlined herein (e.g., the pI variants and steric variants). Each set of variants can be independently and optionally included or excluded from any particular heterodimeric protein.

1. FcγR Variants

Accordingly, there are a number of useful Fc substitutions that can be made to alter binding to one or more of the FcγR receptors. In certain embodiments, the subject antibody includes modifications that alter the binding to one or more FcγR receptors (i.e., "FcγR variants"). Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the subject antibodies include those listed in U.S. Pat. No. 8,188,321 (particularly FIG. 41) and U.S. Pat. No. 8,084,582, and US Publ. App. Nos. 20060235208 and 20070148170, all of which are expressly incorporated herein by reference in their entirety and specifically for the variants disclosed therein that affect Fcγ receptor binding. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T. Such modification may be included in one or both Fc domains of the subject antibody.

In some embodiments, the subject antibody includes one or more Fc modifications that increase serum half-life. Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L. Such modification may be included in one or both Fc domains of the subject antibody.

2. Ablation Variants

In some embodiments, the heterodimeric antibody (e.g., anti-B7H3×anti-CD28 bispecific antibody) includes one or more modifications that reduce or remove the normal binding of the Fc domain to one or more or all of the Fcγ receptors (e.g., FcγR1, FcγRIIa, FcγRIIb, FcγRIIIa, etc.) to avoid additional mechanisms of action. Such modifications are referred to as "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific antibodies that bind CD28 monovalently, it is generally desirable to ablate FcγRIIIa binding to eliminate or significantly reduce ADCC activity. In some embodiments, of the subject antibodies described herein, at least one of the Fc domains comprises one or more Fcγ receptor ablation variants. In some embodiments, of the subject antibodies described herein, both of the Fc domains comprises one or more Fcγ receptor ablation variants. These ablation variants are depicted in FIG. 5, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

E. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

Exemplary combination of variants that are included in some embodiments of the heterodimeric 1+1 Fab-scFv-Fc, 2+1 Fab₂-scFv-Fc, 1+1 CLC and 2+1 CLC format antibodies are included in FIG. 8. In some embodiments, the heterodimeric antibody includes a combination of variants as depicted in FIG. 8. In certain embodiments, the antibody is a heterodimeric 1+1 Fab-scFv-Fc, 2+1 Fab₂-scFv-Fc, 1+1 CLC or 2+1 CLC format antibody.

F. Useful Antibody Formats

As will be appreciated by those in the art and discussed more fully below, the heterodimeric bispecific antibodies provided herein can take on several different configurations as generally depicted in FIGS. 33 and 34.

As will be appreciated by those in the art, the heterodimeric formats of the invention can have different valencies as well as be bispecific. That is, heterodimeric antibodies of the invention can be bivalent and bispecific, or trivalent and bispecific, wherein the first antigen is bound by two binding domains and the second antigen by a second binding domain. As is outlined herein, when CD28 is one of the target antigens, it is preferable that the CD28 is bound only monovalently.

The present invention utilizes CD28 antigen binding domains in combination with B7H3 binding domains. As will be appreciated by those in the art, any collection of anti-CD28 CDRs, anti-CD28 variable light and variable heavy domains, Fabs and scFvs as depicted in any of the figures (see particularly FIGS. 16-21) can be used. Similarly, any of the anti-B7H3 antigen binding domains can be used, whether CDRs, variable light and variable heavy domains, Fabs and scFvs as depicted in any of the Figures (e.g., FIGS. 29-31) can be used, optionally and independently combined in any combination.

1. 1+1 Fab-scFv-Fc Format ("Bottle Opener")

One heterodimeric antibody format that finds particular use in subject bispecific antibodies provided herein (e.g., anti-CD28×anti-B7H3 antibody) is the "1+1 Fab-scFv-Fc" or "bottle opener" format as shown in FIG. 33A. The 1+1 Fab-scFv-Fc format antibody includes a first monomer that is a "regular" heavy chain (VH1-CH1-hinge-CH2-CH3), wherein VH1 is a first variable heavy domain and CH2-CH3 is a first Fc domain. The 1+1 Fab-scFv-Fc also includes a light chain that includes a first variable light domain VL1 and a constant light domain CL. The light chain interacts with the VH1-CH1 of the first monomer to form a first antigen binding domain that is a Fab. The second monomer of the antibody includes a second binding domain that is a single chain Fv ("scFv", as defined below) and a second Fc domain. The scFv includes a second variable heavy domain (VH2) and a second variable light domain (VL2), wherein the VH2 is attached to the VL2 using an scFv linker that can be charged (see, e.g., FIG. 6). The scFv is attached to the heavy chain using a domain linker (see, e.g., FIG. 7). The two monomers are brought together by the use of amino acid variants (e.g., heterodimerization variants, discussed above) in the constant regions (e.g., the Fc domain, the CH1 domain and/or the hinge region) that promote the formation of heterodimeric antibodies as is described more fully below. This structure is sometimes referred to herein as the "bottle-opener" format, due to a rough visual similarity to a bottle-opener. In some embodiments, the 1+1 Fab-scFv-Fc format antibody is a bivalent antibody.

There are several distinct advantages to the present "1+1 Fab-scFv-Fc" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g., heavy 1 pairing with light 2, etc.).

In some embodiments of the 1+1 Fab-scFv-Fc format antibody, one of the first or second antigen binding domain is a CD28 binding domain and the other binding domain is a tumor associated antigen (TAA) binding domain. In some embodiments where the 1+1 Fab-scFv-Fc includes a CD28 binding domain and a tumor associated antigen (TAA) binding domain, it is the scFv that binds to the CD28, and the Fab that binds the TAA. In some embodiments, the TAA is B7H3. Exemplary anti-B7H3×anti-CD28 bispecific antibodies in the 1+1 Fab-scFv-Fc format is depicted in FIG. 35.

In some embodiments, the first and second Fc domains of the 1+1 Fab-scFv-Fc format antibody are variant Fc domains that include heterodimerization skew variants (e.g., a set of amino acid substitutions as shown in FIGS. 3 and 9). Particularly useful heterodimerization skew variants include S364K/E357Q:L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first monomer includes pI variants (including those shown in FIG. 4). In exemplary embodiments, the constant domain (CH1-hinge-CH2-CH3) of the first monomer includes pI variants N208D/Q295E/N384D/Q418E/N421D, wherein numbering is according to EU numbering.

In exemplary embodiments, the CH1-hinge-CH2-CH3 of the first monomer comprises amino acid variants L368D/K370S/N208D/Q295E/N384D/Q418E/N421D/E233P/L234V/L235A/G236del/S267K, the second Fc domain comprises amino acid variants S364K/E357Q/E233P/L234V/L235A/G236del/S267K, wherein numbering is according to EU numbering.

In some embodiments, the scFv of the 1+1 Fab-scFv-Fc format antibody provided herein includes a charged scFv linker (including those shown in FIG. 6). In some embodiments, the 1+1 Fab-scFv-Fc format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering. In some embodiments, the scFv of the 1+1 Fab-scFv-Fc format antibody provided herein includes a (GKPGS)$_4$ charged scFv linker. In some embodiments, the 1+1 Fab-scFv-Fc format antibody provided herein includes FcRn variants M428L/N434S, wherein numbering is according to EU numbering.

In some embodiments, one of the first binding domain or the second binding domain binds CD28 and the other binding domain binds a tumor associated antigen (TAA) (see FIG. 34A). Any suitable CD28 binding domain can be included in subject 1+1 Fab-scFv-Fc format antibody, including any of the CD28 binding domains provided herein. In some embodiments, the CD28 binding domain is one of the following CD28 binding domains or a variant thereof: 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing).

In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, one of the first binding domain or the second binding domain of the 1+1 Fab-scFv-Fc format antibody binds a tumor associated antigen (TAA). Suitable TAAs include any of the TAAs disclosed herein. In exemplary embodiments, the TAA is B7H3. Any suitable B7H3 binding domain can be included in subject 1+1 Fab-scFv-Fc format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_ L1, 6A1[B7H3]_H1L1, omburtuzumab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

In some embodiments, the 1+1 Fab-scFv-Fc format antibody includes a first binding domain that binds CD28 and a second binding domain that binds B7H3. In some embodiments, the CD28 binding domain is one of the following CD28 binding domains or a variant thereof: 1A7[CD28]_ H1.14L1, 1A7[CD28]_H1_L1.71, 1A7[CD28]_ H1.1_L1.71, 1A7[CD28]_H1.14_L1.71, CD28.3[CD28]_ H0L0, TGN1412_H1L1, 341VL34[CD28]_H1L1, 341VL36[CD28]_H1L1, 281VL4[CD28]_H1L1, HuTN228 [CD28]_H1L1, PV1[CD28]_H0L0, m9.3[CD28]_H0L0, hu9.3[CD28]_H1L1 (FIGS. 18-21 and 23 and Sequence Listing).

In some embodiments, the B7H3 binding domain is one of the following B7H3 binding domains or a variant thereof: 2E4A3.189[B7H3]_H1L1, 2E4A3.189[B7H3]_H1/1A7 [CD28]_L1, 2E4A3.189[B7H3]_H1.22L1, 2E4A3.189 [B7H3]_H1.22/1A7[CD28]_L1, 6A1[B7H3]_H1L1, omburtuzumab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing).

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; l) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524;

q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; ll) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

FIG. 10 shows some exemplary Fc domain sequences that are useful in the 1+1 Fab-scFv-Fc format antibodies. The "monomer 1" sequences depicted in FIG. 10 typically refer to the Fc domain of the "Fab-Fc heavy chain" and the "monomer 2" sequences refer to the Fc domain of the "scFv-Fc heavy chain." In addition, FIGS. 12-15 provides exemplary CH1-hinge domains, CH1 domains, and hinge domains that can be included in the first or second monomer of the 1+1 Fab-scFv-Fc format. Further, FIG. 16 provides useful CL sequences that can be used with this format.

2. 2+1 Fab$_2$-scFv-Fc Format (Central-scFv Format)

One heterodimeric antibody format that finds particular use in the subject bispecific antibodies provided herein (e.g., anti-CD28×anti-B7H3 antibody) is the 2+1 Fab$_2$-scFv-Fc format (also referred to as "central-scFv format") shown in FIG. 33B. This antibody format includes three antigen binding domains: two Fab portions and an scFv that is inserted between the VH—CH1 and CH2-CH3 regions of one of the monomers. In some embodiments of this format, the Fab portions each bind a tumor associated antigen (TAA) and the "extra" scFv domain binds CD28. In some embodiments, the 2+1 Fab$_2$-scFv-Fc format antibody is a trivalent antibody.

In some embodiments of the 2+1 Fab$_2$-scFv-Fc format, a first monomer includes a standard heavy chain (i.e., VH1-CH1-hinge-CH2-CH3), wherein VH1 is a first variable heavy domain and CH2-CH3 is a first Fc domain. A second monomer includes another first variable heavy domain (VH1), a CH1 domain (and optional hinge), a second Fc domain, and an scFv that includes an scFv variable light domain (VL2), an scFv linker and a scFv variable heavy domain (VH2). The scFv is covalently attached between the C-terminus of the CH1 domain of the second monomer and the N-terminus of the second Fc domain using optional domain linkers (VH1-CH1-[optional linker]-VH2-scFv linker-VH2-[optional linker]-CH2-CH3, or the opposite orientation for the scFv, VH1-CH1-[optional linker]-VL2-scFv linker-VH2-[optional linker]-CH2-CH3). The optional linkers can be any suitable peptide linkers, including, for example, the domain linkers included in FIG. 7. This embodiment further utilizes a common light chain that includes a variable light domain (VL1) and a constant light domain (CL). The common light chain associates with the VH1-CH1 of the first and second monomers to form two identical Fabs. In some embodiments, the identical Fabs each bind a tumor associated antigen (e.g., B7H3). As for many of the embodiments herein, these constructs can include skew variants, pI variants, ablation variants, additional Fc variants, etc. as desired and described herein.

In some embodiments, the first and second Fc domains of the 2+1 Fab$_2$-scFv-Fc format antibody are variant Fc domains that include heterodimerization skew variants (e.g., a set of amino acid substitutions as shown in FIGS. 3 and 9). Particularly useful heterodimerization skew variants include S364K/E357Q:L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/ Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/ G236_/S267K, wherein numbering is according to EU numbering.

In some embodiments, the constant domain (CH1-hinge-CH2-CH3) of the first monomer includes pI variants (including those shown in FIG. 4). In exemplary embodiments, the constant domain (CH1-hinge-CH2-CH3) of the first monomer includes pI variants N208D/Q295E/N384D/Q418E/ N421D, wherein numbering is according to EU numbering.

In some embodiments, the scFv of the 2+1 Fab$_2$-scFv-Fc format antibody provided herein includes a charged scFv linker (including those shown in FIG. 6). In some embodiments, the 2+1 Fab$_2$-scFv-Fc format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/ L234V/L235A/G236_/S267K; and the constant domain (CH1-hinge-CH2-CH3) of the first monomer includes pI variants N208D/Q295E/N384D/Q418E/N421D, wherein numbering is according to EU numbering. In some embodiments, the scFv of the 2+1 Fab$_2$-scFv-Fc format antibody provided herein includes a (GKPGS)$_4$ charged scFv linker. In some embodiments, the 2+1 Fab$_2$-scFv-Fc format antibody provided herein includes FcRn variants M428L/ N434S, wherein numbering is according to EU numbering.

In some embodiments, the CH1-hinge-CH2-CH3 of the first monomer comprises amino acid variants L368D/ K370S/N208D/Q295E/N384D/Q418E/N421D/E233P/ L234V/L235A/G236del/S267K, and the second Fc domain comprises amino acid variants S364K/E357Q/E233P/L234V/L235A/G236del/S267K, wherein numbering is according to EU numbering.

In some embodiments, the scFv of the second monomer of the 2+1 Fab₂-scFv-Fc format antibody is a CD28 binding and the VH1 of the first and second monomer and the VL1 of the common light chain each form binding domains that bind a tumor associated antigen (TAA, e.g., B7H3) (see FIG. 34B). Any suitable CD28 binding domain can be included in subject 2+1 Fab₂-scFv-Fc format antibody, including any of the CD28 binding domains provided herein. In some embodiments, the CD28 binding domain is one of the following CD28 binding domains or a variant thereof: 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and the Sequence Listing). In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the VH1 of the first and second monomer and the VL1 of the common light chain of the 2+1 Fab₂-scFv-Fc format antibody each form a binding domain that binds a tumor associated antigen (TAA) (see FIG. 34B). Suitable TAAs include any of the TAAs disclosed herein. In exemplary embodiments, the TAA is B7H3. Any suitable B7H3 binding domain can be included in subject 2+1 Fab₂-scFv-Fc format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing). In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; l) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; ll) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

FIG. 11 shows some exemplary Fc domain sequences that are useful with the 2+1 Fab$_2$-scFv-Fc format. The "monomer 1" sequences depicted in FIG. 11 typically refer to the Fc domain of the "Fab-Fc heavy chain" and the "monomer 2" sequences refer to the Fc domain of the "Fab-scFv-Fc heavy chain." In addition, FIGS. 12-15 provides exemplary CH1-hinge domains, CH1 domains, and hinge domains that can be included in the first or second monomer of the 2+1 Fab$_2$-scFv-Fc format. Further, FIG. 16 provides useful CL sequences that can be used with this format. Exemplary anti-B7H3×anti-CD28 bispecific antibodies in the 2+1 Fab$_2$-scFv-Fc format are depicted in FIG. 36.

3. 1+1 CLC Format

One heterodimeric antibody format that finds particular use in subject bispecific antibodies provided herein (e.g., anti-CD28×anti-B7H3 antibody) is the "1+1 Common Light Chain" or "1+1 CLC" format, which is depicted in FIG. 33C. The 1+1 CLC format antibody includes a first monomer that includes a VH1-CH1-hinge-CH2-CH3, wherein VH1 is a first variable heavy domain and CH2-CH3 is a first Fc domain; a second monomer that includes a VH2-CH1-hinge-CH2-CH3, wherein VH2 is a second variable heavy domain and CH2-C3 is a second Fc domain; and a third monomer "common light chain" comprising VL-CL, wherein VL is a common variable light domain and CL is a constant light domain. In such embodiments, the VL pairs with the VH1 to form a first binding domain with a first antigen binding specificity; and the VL pairs with the VH2 to form a second binding domain with a second antigen binding specificity. In some embodiments, the 1+1 CLC format antibody is a bivalent antibody.

In some embodiments, the first and second Fc domains of the 1+1 CLC format are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/Y349C: T366W/S354C (EU numbering). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first or second monomer includes pI variants (including those shown in FIG. 4). In exemplary embodiments, the constant domain (CH1-hinge-CH2-CH3) of the first or second monomer includes pI variants N208D/Q295E/N384D/Q418E/N421D, wherein numbering is according to EU numbering.

In some embodiments, the 1+1 CLC format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering.

In some embodiments, the CH1-hinge-CH2-CH3 of the first monomer comprises amino acid variants L368D/K370S/N208D/Q295E/N384D/Q418E/N421D/E233P/L234V/L235A/G236del/S267K, and the second Fc domain comprises amino acid variants S364K/E357Q/E233P/L234V/L235A/G236del/S267K, wherein numbering is according to EU numbering.

In some embodiments, the 1+1 CLC format antibody provided herein further includes FcRn variants M428L/N434S, wherein numbering is according to EU numbering.

In some embodiments, one of the first binding domain or the second binding domain binds CD28 and the other binding domain binds a tumor associated antigen (TAA) (see FIG. 34C). Any suitable CD28 binding domain can be included in subject 1+1 CLC format antibody, including any of the CD28 binding domains provided herein. In some embodiments, the CD28 binding domain is one of the following CD28 binding domains or a variant thereof: 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing). In exemplary embodiments, the CD28 binding domain includes a 1A7[CD28]_H1.14 variable heavy domain. In some embodiments, the CD28 binding domain includes a 1A7[CD28]_H1.14 variable heavy domain or variant thereof and a light variable domain of any of the CD28 binding domains provided herein. In exemplary embodiments, the CD28 binding domain is 1A7[CD28]_H1.14L1 or a variant thereof. In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, one of the first binding domain or the second binding domain of the 1+1 CLC format antibody binds a tumor associated antigen (TAA). Suitable TAAs include any of the TAAs disclosed herein. In exemplary embodiments, the TAA is B7H3. Any suitable B7H3 binding domain can be included in subject 1+1 CLC format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; l) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; ll) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In exemplary embodiments, the B7H3 binding domain includes a 1A7[CD28]_H1.14 variable heavy domain. In some embodiments, the B7H3 binding domain includes a 2E4A3.189[B7H3]_H1.22 variable heavy domain and a light variable domain of any of the CD28 or B7H3 binding domains provided herein. In exemplary embodiments, the B7H3 binding domain includes a 2E4A3.189[B7H3]_H1.22 variable heavy domain or a variant thereof and a 1A7[CD28]_L1 variable light domain or a variant thereof.

In some embodiments, the 1+1 CLC format antibody includes a first binding domain that binds CD28 and a second binding domain that binds B7H3. In particular embodiments, the variable heavy domain of the first binding domain (i.e., the CD28 binding domain) is a 1A7[CD28]_H1.14 variable heavy domain or variant thereof. In some embodiments, the variable heavy domain of the second binding domain (i.e., the B7H3 binding domain) is a 2E4A3.189[B7H3]_H1.22 variable heavy domain or variant thereof. In some embodiments, the 1+1 CLC format antibody includes a common light chain that includes the variable light domain of any of the CD28 or B7H3 binding domains provided herein. In some embodiments, the variable light domain is a 1A7[CD28]_L1 variable light domain or a variant thereof. Exemplary anti-B7H3×anti-CD28 bispecific antibodies in the 1+1 CLC format are depicted in FIG. 37.

4. 2+1 CLC Format

Another heterodimeric antibody format that finds particular use in subject bispecific antibodies provided herein (e.g., anti-CD28×anti-B7H3 antibody) is the "2+1 Common Light Chain" or "2+1 CLC" format, which is depicted in FIG. 33D. The 2+1 CLC format includes a first monomer that includes a VH1-CH1-linker-VH1-CH1-hinge-CH2-CH3, wherein the VH1s are each a first variable heavy domain and CH2-CH3 is a first Fc domain; a second monomer that includes a VH2-CH1-hinge-CH2-CH3, wherein VH2 is a second variable heavy domain and CH2-CH3 is a second Fc domain; and a third monomer that includes a "common light chain" VL-CL, wherein VL is a common variable light domain and CL is a constant light domain. The VL pairs with each of the VH1s of the first monomer to form two first binding domains, each with a first antigen binding specificity; and the VL pairs with the VH2 to form a second binding domain with a second antigen binding specificity. The linker of the first monomer can be any suitable linker, including any one of the domain linkers or combinations thereof described in FIG. 7. In some embodiments, the linker is EPKSCGKPGSGKPGS (SEQ ID NO:1182). In some embodiments, the 2+1 CLC format antibody is a trivalent antibody.

In some embodiments, the first and second Fc domains of the 2+1 CLC format are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/ Y407V: T366W and T366S/L368A/Y407V/Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/ G236_/S267K, wherein numbering is according to EU numbering.

In some embodiments, the constant domain (CH1-hinge-CH2-CH3) of the first or second monomer includes pI variants (including those shown in FIG. 4). In exemplary embodiments, the constant domain (CH1-hinge-CH2-CH3) of the first or second monomer includes pI variants N208D/ Q295E/N384D/Q418E/N421D, wherein numbering is according to EU numbering.

In some embodiments, the 2+1 CLC format antibody provided herein further includes FcRn variants M428L/ N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/ L234V/L235A/G236_/S267K; and the constant domain (CH1-hinge-CH2-CH3) of the first monomer includes pI variants N208D/Q295E/N384D/Q418E/N421D, wherein numbering is according to EU numbering. In some embodiments, the 2+1 CLC format antibody provided herein further includes FcRn variants M428L/N434S, wherein numbering is according to EU numbering.

In some embodiments, the CH1-hinge-CH2-CH3 of the second monomer comprises amino acid variants L368D/ K370S/N208D/Q295E/N384D/Q418E/N421D/E233P/ L234V/L235A/G236del/S267K, and the first Fc domain comprises amino acid variants S364K/E357Q/E233P/ L234V/L235A/G236del/S267K, wherein numbering is according to EU numbering.

In some embodiments, each of the two first binding domains binds a tumor associated antigen (TAA) and the second binding domain binds CD28 (see FIG. 34D). Any suitable CD28 binding domain can be included in the subject 2+1 CLC format antibody, including any of the CD28 binding domains provided herein. In some embodiments, the CD28 binding domain is one of the following CD28 binding domains or a variant thereof: 1A7[CD28]_H1.14L1, 1A7 [CD28]_H1_L1.71, 1A7[CD28]_H1.1_L1.71, 1A7[CD28]_ H1.14_L1.71, CD28.3[CD28]_H0L0, TGN1412_H1L1, 341VL34[CD28]_H1L1, 341VL36[CD28]_H1L1, 281VL4 [CD28]_H1L1, HuTN228[CD28]_H1L1, PV1[CD28]_ H0L0, m9.3[CD28]_H0L0, hu9.3[CD28]_H1L1 (FIGS. 18-21 and 23 and Sequence Listing). In exemplary embodiments, the CD28 binding domain includes a 1A7[CD28]_ H1.14 variable heavy domain. In some embodiments, the CD28 binding domain includes a 1A7[CD28]_H1.14 variable heavy domain or variant thereof and a light variable domain of any of the CD28 binding domains provided herein. In exemplary embodiments, the CD28 binding domain is 1A7[CD28]_H1.14L1 or a variant thereof.

In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, each of the two first binding domains binds a tumor associated antigen (TAA). In certain embodiments, the two first binding domains bind the same TAA. Suitable TAAs include any of the TAAs disclosed herein. In exemplary embodiments, the TAA is B7H3. Any suitable B7H3 binding domain can be included in subject 2+1 CLC format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; l) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; ll) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In exemplary embodiments, the B7H3 binding domain includes a 1A7[CD28]_H1.14 variable heavy domain. In some embodiments, the B7H3 binding domain includes a 2E4A3.189[B7H3]_H1.22 variable heavy domain and a light variable domain of any of the CD28 or B7H3 binding domains provided herein. In exemplary embodiments, the B7H3 binding domain includes a 2E4A3.189[B7H3]_H1.22 variable heavy domain or a variant thereof and a 1A7 [CD28]_L1 variable light domain or a variant thereof.

In some embodiments, the 2+1 CLC format antibody includes two first binding domains that each bind B7H3 and a second binding domain that binds CD28. In some embodiments, the variable heavy domain of each of the first binding domains (i.e., the B7H3 binding domains) is a 2E4A3.189 [B7H3]_H1.22 variable heavy domain or variant thereof. In particular embodiments, the variable heavy domain of the second binding domain (i.e., the CD28 binding domain) is a 1A7[CD28]_H1.14 variable heavy domain or variant thereof. In some embodiments, the 2+1 CLC format antibody includes a common light chain that includes the variable light domain of any of the CD28 or B7H3 binding domains provided herein. In some embodiments, the variable light domain is a 1A7[CD28]_L1 variable light domain or a variant thereof. Exemplary anti-B7H3×anti-CD28 bispecific antibodies in the 2+1 CLC format are depicted in FIG. 38.

FIG. 13 depicts sequences for "CH1+ half hinge" domain linker that find use in embodiments of the 2+1 CLC format. In the 2+1 CLC format, the "CH1+ half hinge" sequences find use linking the first variable heavy domain ($V_H$) to the second VH domain on the Fab-Fab-Fc side of the bispecific antibody.

In some embodiments, the second monomer comprises the amino acid sequence of SEQ ID NO:1019, the first monomer comprises the amino acid sequence of SEQ ID NO:1020, and the light chain has the amino acid sequence of SEQ ID NO:1021.

5. 2+1 mAb-scFv Format

One heterodimeric antibody format that finds particular use in the subject bispecific antibodies provided herein (e.g., anti-CD28×anti-B7H3 antibody) is the 2+1 mAb-scFv format shown in FIG. 33E. This antibody format includes three antigen binding domains: two Fab portions and an scFv that is attached to the C-terminal of one of the heavy chains. In some embodiments of this format, the Fab portions each bind a tumor associated antigen (TAA), in this case, human B7H3 and the "extra" scFv domain binds CD28. That is, this mAb-scFv format is a trivalent antibody.

In these embodiments, the first chain or monomer comprises, from N- to C-terminal, VH1-CH1-hinge-CH2-CH3, the second monomer comprises, from N- to C-terminal, VH1-CH1-hinge-CH2-CH3-domain linker-scFv domain, where the scFv domain comprises a second VH (VH2), a second VL (VL2) and a scFv linker. As for all the scFv domains herein, the scFv domain can be in either orientation, from N- to C-terminal, VH2-scFv linker-VL2 or VL2-scFv linker-VH2. Accordingly, the second monomer may comprise, from N- to C-terminal, VH1-CH1-hinge-CH2-CH3-domain linker-VH2-scFv linker-VL2 or VH1-CH1-hinge-CH2-CH3-domain linker-VL2-scFv linker-VH2. The composition also comprises a light chain, VL1-CL. In these embodiments, the VH1-VL1 each form a first ABD and the VH2-VL2 form a second ABD. In some embodiments, the first ABD binds to a tumor target antigen, including human B7H3, and the second ABD binds human CD28.

In some embodiments, the first and second Fc domains of the 2+1 mAb-scFv format antibody are variant Fc domains that include heterodimerization skew variants (e.g., a set of amino acid substitutions as shown in FIGS. 3 and 9). Particularly useful heterodimerization skew variants include S364K/E357Q:L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/ Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/ G236_/S267K, wherein numbering is according to EU numbering.

In some embodiments, the constant domain (CH1-hinge-CH2-CH3) of the first monomer includes pI variants (including those shown in FIG. 4). In exemplary embodiments, the constant domain (CH1-hinge-CH2-CH3) of the first monomer includes pI variants N208D/Q295E/N384D/Q418E/ N421D, wherein numbering is according to EU numbering.

In some embodiments, the scFv of the 2+1 mAb-scFv format antibody provided herein includes a charged scFv linker (including those shown in FIG. 6). In some embodiments, the 2+1 mAb-scFv format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/ L234V/L235A/G236_/S267K; and the constant domain (CH1-hinge-CH2-CH3) of the first monomer includes pI variants N208D/Q295E/N384D/Q418E/N421D, wherein numbering is according to EU numbering. In some embodiments, the scFv of the 2+1 mAb-scFv format antibody provided herein includes a (GKPGS)$_4$ charged scFv linker. In some embodiments, 2+1 mAb-scFv format antibody provided herein includes FcRn variants M428L/N434S, wherein numbering is according to EU numbering.

In some embodiments, the scFv of the second monomer of the 2+1 Fab$_2$-scFv-Fc format antibody is a CD28 binding and the VH1 of the first and second monomer and the VL1 of the common light chain each form binding domains that bind a tumor associated antigen (TAA, e.g., B7H3) (see FIG. 26B). Any suitable CD28 binding domain can be included in subject 2+1 mAb-scFv format antibody, including any of the CD28 binding domains provided herein. In some embodiments, the CD28 binding domain is one of the following CD28 binding domains or a variant thereof: 1A7[CD28]_ H1L1, 1A7[CD28]_H1.14L1, 1A7[CD28]_H1_L1.71, 1A7 [CD28]_H1.1_L1.71, 1A7[CD28]_H1.14_L1.71, CD28.3 [CD28]_H0L0, TGN1412_H1L1, 341VL34[CD28]_H1L1, 341VL36[CD28]_H1L1, 281VL4[CD28]_H1L1, HuTN228 [CD28]_H1L1, PV1[CD28]_H0L0, m9.3[CD28]_H0L0, hu9.3[CD28]_H1L1 (FIGS. 18-21 and 23 and Sequence Listing).

In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the VH1 of the first and second monomer and the VL1 of the common light chain of the 2+1 Fab$_2$-scFv-Fc format antibody each form a binding domain that binds a tumor associated antigen (TAA) (see FIG. 26B). Suitable TAAs include any of the TAAs disclosed herein. In exemplary embodiments, the TAA is B7H3. Any suitable B7H3 binding domain can be included in subject 2+1 Fab$_2$-scFv-Fc format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

FIGS. 10-11 show some exemplary Fc domain sequences that are useful with the 2+1 mAb-scFv format. The "monomer 1" sequences depicted in FIG. 10 typically refer to the Fc domain of the "Fab-Fc heavy chain" and the "monomer 2" sequences refer to the Fc domain of the "Fab-Fc-scFv" heavy chain." In addition, FIGS. 12-14 provides exemplary CH1 (optionally including hinge or half-hinge domains) that can be used in either the "Fab-Fc heavy chain" monomer or the "Fab-Fc-scFv" heavy chain." FIG. 15 provides exemplary hinge domains that may be used in either the "Fab-Fc heavy chain" monomer or the "Fab-Fc-scFv" heavy chain." Further, FIG. 16 provides useful CL sequences that can be used with this format.

6. Monospecific, Monoclonal Antibodies

As will be appreciated by those in the art, the novel Fv sequences outlined herein can also be used in both monospecific antibodies (e.g., "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

In some embodiments, the monospecific antibody is a B7H3 monospecific antibody. In certain embodiments, the monospecific anti-B7H3 antibody includes the 6 CDRs of any of the following B7H3 antigen binding domains: 2E4A3.189[B7H3]_H1L1, 2E4A3.189[B7H3]_H1/1A7[CD28]_L1, 2E4A3.189[B7H3]_H1.22_L1, 2E4A3.189[B7H3]_H1.22/1A7[CD28]_L1, 6A1[B7H3]_H1L1, 3C4[B7H3]_H1L1.1, and 4F12[B7H3]_H2L1.1 (FIGS. 26-31). In some embodiments, the monospecific B7H3 antibody includes the variable heavy domain and variable light domain of any of the following B7H3 antigen binding domains: 2E4A3.189[B7H3]_H1L1, 2E4A3.189[B7H3]_H1/1A7[CD28]_L1, 2E4A3.189[B7H3]_H1.22_L1, 2E4A3.189[B7H3]_H1.22/1A7[CD28]_L1, 6A1[B7H3]_H1L1, 3C4[B7H3]_H1L1.1, and 4F12[B7H3]_H2L1.1 (FIGS. 26-31).

In some embodiments, the monospecific antibody is a CD28 monospecific antibody. In certain embodiments, the monospecific anti-CD28 antibody includes the 6 CDRs of any of the following CD28 antigen binding domains: 1A7[CD28]_H1L1, and 1A7[CD28]_H1.14_L1; (FIGS. 18 and 19). In some embodiments, the monospecific anti-CD28 antibody includes the variable heavy domain and variable light domain of any of the CD28 antigen binding domains: 1A7[CD28]_H1L1, and 1A7[CD28]_H1.14_L1 (FIGS. 18 and 19).

VI. Nucleic Acids

In another aspect, provided herein are nucleic acid compositions encoding the antigen binding domains and anti-B7H3 and anti-CD28 antibodies provided herein (e.g., αB7H3ΔαCD28 bispecific antibodies).

As will be appreciated by those in the art, the nucleic acid compositions will depend on the format and scaffold of the heterodimeric protein. Thus, for example, when the format requires three amino acid sequences, such as for the 1+1 Fab-scFv-Fc or 2+1 Fab₂-scFv-Fc formats, 1+1 CLC and 2+1 CLC formats, three polynucleotides can be incorporated into one or more expression vectors for expression. In exemplary embodiments, each polynucleotide is incorporated into a different expression vector.

As is known in the art, the nucleic acids encoding the components of the binding domains and antibodies disclosed herein can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The polynucleotides and/or expression vectors of the invention are then transformed into any number of different types of host cells as is well known in the art, including mammalian, bacterial, yeast, insect and/or fungal cells, with mammalian cells (e.g., CHO cells), finding use in many embodiments.

In some embodiments, polynucleotides encoding each monomer are each contained within a single expression vector, generally under different or the same promoter controls. In embodiments of particular use in the present invention, each of these polynucleotides are contained on different expression vectors. As shown herein and in U.S. 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The antibodies and ABDs provided herein are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "1+1 Fab-scFv-Fc" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

VII. Biological and Biochemical Functionality of the Anti-CD28×Anti-TAA Antibodies Generally the bispecific anti-CD28×anti-TAA antibodies described herein (e.g., anti-CD28×anti-B7H3) are administered to patients with cancer (e.g., a B7H3 associated cancer), and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays.

A. Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

VIII. Treatments

Once made, the compositions of the invention find use in a number of oncology applications, by treating cancer, generally by enhancing immune responses (e.g., T cell activation and proliferation), particularly when used with anti-cancer therapies such as anti-PD1 and anti-tumor bispecific antibodies. In some embodiments, the antibodies provided herein enhance immune responses (e.g., T cell activation and proliferation) by providing agonistic co-stimulation of T cells in the microenvironment of tumors expressing a TAA of interest (e.g., B7H3).

In some embodiments, the anti-CD28×anti-TAA bispecific antibodies provided herein are administered with an anti-tumor therapy including, for example, a checkpoint inhibitor (e.g., anti-PD1 antibody) or anti-tumor bispecific antibodies.

A. Anti-CD28×Anti-TAA/Anti-TAA Bispecific Antibody

In some embodiments, the anti-CD28×anti-TAA bispecific antibodies provided herein are administered with an anti-tumor bispecific antibody that is a T-cell engaging bispecific antibody, such as those that bind to human Cd3.

In classic T cell/APC interaction, there is a first signal provided by TCR reactivity with peptide-MHC (Signal 1) and a second signal provided by CD28 crosslinking by CD80/CD86 being expressed on APCs (Signal 2) which together fully activate T cells (see FIG. 31A). In contrast, only the first signal is provided in treatment with CD3 bispecific antibodies that target a TAA (i.e., anti-CD3×anti-TAA bispecific antibodies).

Without being bound by any particular theory of operation, it is believed that the anti-CD28×anti-TAA bispecific antibodies provided herein can enhance the anti-tumor response of an anti-CD3×anti-TAA bispecific antibody by CD28 costimulation (see FIG. 31B and Examples 4E and 4F). Thus, in one aspect, provided herein are methods of methods of treating a cancer in a patient by administering the patient an anti-CD3×anti-TAA bispecific antibody and an anti-CD28×anti-TAA bispecific antibody provided herein. In some cases, the TTA is the same in both antibodies; thus, for example, there can be co-administration of an anti-CD28 X B7H3 bispecific antibody with an anti-CD3 X B7H3 antibody. In some cases, the TTAs are different. In some embodiments, the administration of the anti-CD3×anti-TAA bispecific antibody and anti-CD28×anti-TAA bispecific antibody enhances an immune response against the tumor in the patient. In some embodiments, the anti-CD3×anti-TAA bispecific antibody and anti-CD28×anti-TAA binds to different TAAs on the same tumor. In exemplary embodiments, the anti-CD28×anti-TAA is an anti-CD28×anti-B7H3 antibody provided herein.

B. Anti-CD28×Anti-TTA/Checkpoint Inhibitor

In some embodiments, the anti-CD28×anti-TAA bispecific antibodies provided herein are administered with a checkpoint inhibitor (e.g., anti-PD1 antibody). Without being bound by any particular theory of operation, it is believed that checkpoint blockade (e.g. PD-1 blockade) is a useful therapeutic modality to stack with engagement of T cell costimulatory receptors on TILs with agonistic anti-CD28×anti-TAA bispecific antibodies as it would provide broad utility in solid tumors and circumvent CTLA4 inhibition of the CD28 pathway. Thus, in another aspect provided herein is a method of treating a cancer in a patient by administering the patient an anti-CD28×anti-TAA bispecific antibody provided herein and a checkpoint inhibitor. In some embodiments, the administration of the anti-CD28× anti-TAA bispecific antibody and checkpoint inhibitor enhances an immune response against the tumor in the patient. In some embodiments, the checkpoint inhibitor is a PD-1, PD-L1, or CTLA4 inhibitor. In exemplary embodiments, the PD-1 inhibitor is an anti-PD-1, anti-PD-L1 or anti-CTLA4 antibody.

C. Administrative Modalities

The antibodies provided herein administered to a subject, in accord with known methods, such as intravenous administration as a bolus or by continuous infusion over a period of time.

D. Treatment Modalities

In the methods of the invention, therapy is used to provide a positive therapeutic response with respect to a disease or condition.

By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

Background

While checkpoint blockade immunotherapies have proven to be effective, many patients nonetheless fail to achieve a response. Engagement of T cell costimulatory receptors on TILs with agonistic antibodies could provide an additional positive signal capable of overcoming negative signals of immune checkpoints and may be a useful therapeutic modality to stack with checkpoint blockade. However, systemic agonism of costimulatory receptors may nonetheless result in systemic toxicity. B7H3 has been found to be broadly overexpressed in cancer cells and tumor vascular cells and may be useful as a tumor target. Accordingly, αB7H3ΔαCD28 bispecific antibodies (bsAbs) were engineered with the aim to target agonistic CD28 binding domains to the tumor environment thereby reducing the potential for systemic toxicity.

Example 1: CD28 Binding Domains

1A: Novel CD28 Binding Domains

An approach considered to avoid the superagonism associated with TGN1412 was to generate novel CD28 binding domains having lower affinity binding to CD28 and/or binding to a different CD28 epitope than TGN1412. In one campaign to generate such novel CD28 binding domains, in-house de novo phage libraries were panned against CD28. In another campaign, rat hybridomas were used to generate additional CD28 binding domains.

1A(a): Phage-Derived Clone 1A7

It should be noted that this phage library utilized a human germline VL with diversity introduced into the LCDR3. The amino acid sequences for exemplary phage-derived clone 1A7 are depicted in FIG. 18.

The phage-derived clones were formatted as bivalent mAbs to investigate their binding characteristics. Plasmids containing the variable heavy and variable light domains of select clones were constructed by Gibson assembly and subcloned into a pTT5 expression vector containing the coding sequence for the IgG1 constant regions (with E233P/L234V/L235A/G236del/S67K ablation variants). DNA was transfected in HEK293E for expression and resulting bivalent mAbs were purified from the supernatant using protein A chromatography.

Affinity of the phage-derived bivalent mAbs for CD28 was screened using Octet, a BioLayer Interferometry (BLI)-based method. Experimental steps for Octet generally include the following: Immobilization (capture of ligand to a biosensor); Association (dipping of ligand-coated biosensors into wells containing the analyte); and Dissociation (returning of biosensors to well containing buffer). The resulting apparent dissociation constant ($KD_{app}$) are depicted in FIG. 24 for XENP28428 (based on clone 1A7) and additional phage-derived comparators.

Binding of the phage-derived bivalent mAbs to cell-surface CD28 was investigated. Human PBMCs were incubated with indicated concentrations of XENP28428 or comparator phage-derived mAbs for 1 hour at 4° C. Cells were then then stained with Alexa Fluor® 647 AffiniPure F(ab')$_2$ Fragment Goat Anti-Human IgG, Fcγ fragment specific secondary antibody (Jackson ImmunoResearch, West Grove, Pa.) for 1 hour at 4° C. and analyzed by flow cytometry. The data (FIG. 25) show that the phage-derived mAbs were able to bind human PBMCs, although with much weaker maximum binding than prior art anti-CD28 mAb HuTN228 (XENP27181, sequences for which are depicted in FIG. 23).

In view of the weaker CD28 binding, 1A7 was further affinity engineered by introducing substitutions into the VH and/or $V_L$. Sequences for such affinity engineered VH and VL regions are depicted as SEQ ID NOS: 585-756 (with illustrative sequences depicted in FIGS. 19-20); and sequences for illustrative affinity engineered $V_H$/VL pairs are depicted in FIG. 21. Consensus sequences for the FR and CDRs are depicted in FIG. 44. Affinity for illustrative affinity engineered 1A7 $V_H$/VL pairs for CD28 are depicted in FIG. 22. Notably, the orientation of the VH and VL domains in the context of an scFv affects the binding affinity. Additionally, formatting the VH and VL domains in the context of a Fab domain (for use in common light chain bispecific mAb formats) as opposed to scFv also affects the binding affinity.

1B: Additional CD28 Binding Domains $V_H$, $V_L$, and CDR sequences for additional CD28 binding domains which may find use in the αB7H3ΔαCD28 bsAbs of the invention are depicted as SEQ ID NOs: 1-88.

Example 2: B7H3 Binding Domains

2A: Novel B7H3 Binding Domain

In one campaign to generate novel B7H3 binding domains, in-house de novo phage libraries were panned against B7H3. In another campaign, rat hybridomas were used to generate additional B7H3 binding domains.

2A(a): Phage-Derived Clone 2E4A3.189

It should be noted that this phage library was intended to discover binding domains suitable for use in common light chain bispecific antibody formats. Accordingly, it utilized the same human germline VL as in Example 1A(a) except without any diversity. The amino acid sequences for exemplary phage-derived clone 2E4A3.189 are depicted in FIG. 26. While this phage-derived clone is useful for enabling common light chain bispecific antibody formats, it had very weak binding affinity for B7H3 and required affinity engineering. As will be further described in Example 3B, the VH of 2E4A3.189 pairs productively with the VL of 1A7, but the VH of 1A7 does not pair productively with the VL of 2E4A3.189 (despite one amino acid difference). Accordingly to improve affinity, 2E4A3.189 was engineered with substitutions into the VH only, sequences for which are depicted as SEQ ID NOS: 497-584 and in FIG. 27, and paired with the VL of 1A7. Consensus sequences for the FR and CDRs are depicted in FIG. 75.

2B: Hybridoma-Derived Clones

B7H3 binding domains were obtained from rat and rabbit hybridoma and humanized using string content optimization (see, e.g., U.S. Pat. No. 7,657,380, issued Feb. 2, 2010). The amino acid sequences for exemplary humanized rat hybridoma-derived clones 6A1 and 3C4 and humanized rabbit hybridoma-derived clones 4F12 and 38E2 are depicted respectively in FIGS. 28-31. Binding affinities of the hybridoma clones (and affinity-engineered 2E4A3.189 phage clone) for human and cynomolgus B7H3 were determined in the context of 1+1 bsAb format (to obtain monovalent binding affinities), data for which are depicted in FIG. 32.

2C: Additional B7H3 Binding Domains $V_H$, $V_L$, and CDR sequences for additional B7H3 binding domains which may find use in the B7H3×CD28 bsAbs of the invention are depicted as SEQ ID NOs: 89-96.

Example 3: Engineering αB7H3ΔαCD28 bsAbs

A number of formats for B7H3×CD28 bsAbs were conceived, illustrative formats for which are outlined below and in FIG. 33. It should be noted that in each case, the CD28 bispecific antibodies are monovalent for CD28 and incorporate Fc variants to engineered to ablate FcγR binding (such as those depicted in FIG. 5) to avoid potential superagonism.

3A: Fab-scFv-Fc Formats

3A(a): 1+1 Fab-scFv-Fc Format

One format utilizing Fab domains and scFv is the 1+1 Fab-scFv-Fc format (depicted schematically in FIG. 34A) which comprises a first monomer comprising a single-chain Fv ("scFv") with a first antigen binding specificity covalently attached to a first heterodimeric Fc domain, a second monomer comprising a heavy chain variable region ($V_H$) covalently attached to a complementary second heterodimeric Fc domain, and a light chain (LC) transfected separately so that a Fab domain having a second antigen binding specificity is formed with the variable heavy domain. Sequences for illustrative αB7H3ΔαCD28 bsAbs (based on binding domains as described in Examples 1 and 2) in the 1+1 Fab-scFv-Fc format are depicted in FIG. 35.

3A(b): 2+1 Fab$_2$-scFv-Fc Format

Another such format is the 2+1 Fab$_2$-scFv-Fc format (depicted schematically in FIG. 34B) which comprises a first monomer comprising a VH domain covalently attached to an scFv (having a first antigen binding specificity) covalently attached to a first heterodimeric Fc domain, a second monomer comprising a VH domain covalently attached to a complementary second heterodimeric Fc domain, and a LC transfected separately so that Fab domains having a second antigen binding specificity are formed with the VH domains. Sequences for illustrative αB7H3ΔαCD28 bsAbs (based on binding domains as described in Examples 1 and 2) in the 2+1 Fab$_2$-scFv-Fc format are depicted in FIG. 36.

3B: Common Light Chain Format

As described above in Examples 1 and 2, the phage library for discovering CD28 and B7H3 binding domains utilized the same human germline $V_L$, although the CD28 library included diversity in the LCDR3. It was found that the variable light domain of clone 1A7 differed from the variable light domain of anti-B7H3 clone 2E4A3.189 by only a single amino acid in the LCDR3. Accordingly, the possible use of clone 1A7 and clone 2E4A3.189 in a Common Light Chain construct was considered. However, it was surprisingly found that the VH of 2E4A3.189 paired productively with the VL of 1A7, but the VH of 1A7 did not pair productively with the VL of 2E4A3.189 despite only having one amino acid difference in the LCDR3. Further, as noted above, the phage-derived clone 1A7 demonstrated much weaker binding than prior art anti-CD28 mAb HuTN228 providing an opportunity for affinity-optimization. Accordingly, affinity-optimization libraries were generated with focus first on substitutions only in the variable heavy domains of 1A7 and 2E4A3.189. The amino acid sequences for exemplary affinity-optimized 1A7 variable domains H1.1 and H1.14 and affinity-optimized 2E4A3.189 variable heavy domain H1.3 and H1.22 are depicted respectively in FIGS. 19 and 27.

3B(a): 1+1 Common Light Chain Format

One common light chain format is the 1+1 Common Light Chain (CLC) format (depicted schematically in FIG. 34C) which comprises a first monomer comprising VH1-CH1-hinge-CH2-CH3, a second monomer comprising VH2-CH1-hinge-CH2-CH3, and a third monomer comprising VL-CL. The VL pairs with the VH1 to form a binding domain with a first antigen binding specificity; and the VL pairs with the VH2 to form a binding domain with a second antigen binding specificity. Sequences for illustrative αB7H3ΔαCD28 bsAbs (based on binding domains as described here) in the 1+1 CLC format are depicted in FIG. 37.

3B(b): 2+1 Common Light Chain Format

Another common light chain format is the 2+1 CLC format (depicted schematically in FIG. 34D) which comprises a first monomer comprising VH1-CH1-hinge-VH1-CH1-hinge-CH2-CH3, a second monomer comprising VH2-CH1-hinge-CH2-CH3, and a third monomer comprising VL-CL. The VL pairs with the first and second VH1 to form binding domains with a first antigen binding specificity; and the VL pairs with the VH2 to form a binding domain with a second antigen binding specificity. Sequences for illustrative αB7H3ΔαCD28 bsAbs (based on binding domains as described here) in the 2+1 CLC format are depicted in FIG. 38.

3C: 2+1 mAb-scFv Format

An additional format utilizing Fab domains and scFv is the 2+1 mAb-scFv format (depicted schematically in FIG. 34E) which comprises a first monomer comprising a VH domain covalently attached to a first heterodimeric Fc domain covalently attached to an scFv (having a first antigen binding specificity), a second monomer comprising a VH domain covalently attached to a complementary second heterodimeric Fc domain, and a LC transfected separately so that Fab domains having a second antigen specificity are formed with the VH domains. Sequences for illustrative αB7H3ΔαCD28 bsAbs (based on binding domains as described here) in the 2+1 mAb-scFv format are depicted in FIG. 39.

Example 4: Developing B7H3×CD28 bsAbs

In classic T cell/APC interaction, there is a first signal provided by TCR reactivity with peptide-MHC (Signal 1) and a second signal provided by CD28 crosslinking by CD80/CD86 being expressed on APCs (Signal 2) which together fully activate T cells (see FIG. 40A). In contrast in treatment with CD3 bispecifics, only the first signal is provided. In some settings such as treatment of solid tumors, it might be useful to build in the CD28 signal which may be provided by a CD28 bispecific with the idea to promote activation and proliferation through CD28 costimulation (see FIG. 40B). Alternatively, where Signal 1 is already provided by endogenous TCR reactivity with neoepitopes, providing just Signal 2 with a CD28 bispecific antibody may be sufficient to enhance anti-tumor activity. It may nonetheless be useful to stack the CD28 signal with checkpoint blockade to mitigate any checkpoint mediated repression of the added CD28 signal (FIG. 41). The following sections characterize B7H3×CD28 bispecific antibodies of the invention in the context of the foregoing. In this section, B7H3×CD28 bsAbs were engineered in various formats and with various binding domains with an aim to optimize therapeutic properties.

4A: Tuning B7H3×CD28 bsAb Activity

The activity of 1+1 CD28 bispecific formats having monovalent binding to the tumor-associated antigen was compared against the activity of 2+1 CD28 bispecific formats having bivalent binding to the tumor-associated antigen. 50,000 CD3+ T cells were incubated with A549 or SKOV-3 cancer cells as a 10:1 effector:target ratio and treated with a dose titration of the indicated B7H3×CD28 antibodies and plate bound 1 μg/mL plate-bound CD3 antibody (OKT3). 1 day post T cell seeding, cytokines were measured using MSD assay (Meso Scale Discovery, Rockville, Md.). The data depicted in FIG. 42 show that both the B7H3×CD28 bispecific antibodies induced cytokine release by the T cells. Notably, XENP34339 having bivalent B7H3 binding induced cytokine release more potently than XENP34717 having monovalent B7H3 binding. It should be noted that the difference in potency is less pronounced when using B7H3 binding domains having higher affinity binding (data not shown).

In another experiment, the impact of CD28 binding affinity on activity was investigated. MCF7 cancer cell (transfected to express anti-CD3 scFv in order to provide the "Signal 1") were incubated with effector cells at a 1:1 effector:target ratio and the indicated concentrations of XENP34339, XENP35612, XENP35611, and XENP34336. Each of the bsAbs were in the 2+1 CLC format. XENP34339, XENP35612, and XENP35611 each included the 2E4A3.189_H1.22_1A7_L1 B7H3 binding domain while XENP34336 included the lower affinity 2E4A3.189_H1.3_1A7_L1 B7H3 binding domain. XENP34339, XENP35612, XENP35611, and XENP34336 respectively included CD28 binding domains having 77 nM, 270 nM, 610 nM, and 440 nM binding affinity. The data as depicted in FIG. 43 show that increased affinity for CD28 enhances potency of the B7H3×CD28 bsAb.

In another set of experiments, the activity of a panel of B7H3×CD28 bsAbs in the presence of additional cancer cells was investigated. CD3+ T cells were incubated with MDA-MB-2331, LnCAP, or DU145 cancer cells at 1:1 E:T ratio, a constant dose of an illustrative B7H33×CD3 bsAb, and dose titration of B7H3×CD28 bsAbs. Data are depicted in FIG. 43. Consistent with the above, increased affinity for CD28 enhances potency of the B7H3×CD28 bsAb (XENP34398>XENP37808). Additionally, the data also indicate that increased affinity for B7H3 enhances potency of the B7H3×CD28 bsAb (e.g. XENP34398>XENP37810; XENP35151 and XENP35153>XENP34732; and XENP37807>XENP37982). Additionally, the data indicate that the 2+1 CLC format is more potent in enhancing IL-2 secretion in comparison to the 2+1 mAb-scFv format (XENP34398>XENP37807).

4B: Tuning CD28 bsAb Pharmacokinetic Profile

Next, the pharmacokinetic profile of various B7H3×CD28 bsAbs of the invention were investigated.

In a first study, the pharmacokinetics of XENP34398 (having the 2+1 CLC format), XENP36781 (having the 2+1 mAb-scFv format), and XENP34395 (having the 2+1 central scFv format) were all tested in cynomolgus at a range of dosing levels. As depicted in FIG. 45, XENP34398 in the 2+1 CLC format was found to have significantly better pharmacokinetics than the 2+1 mAb-scFv format which was in turn slightly better than the 2+1 Fab$_2$-scFv-Fc format, at each dose level tested. Although there were other differences between these molecules in addition to the format (e.g. differences in the B7H3 binding domain), the data suggest the 2+1 CLC format may be advantageous in the context of B7H3×CD28 bsAbs.

Figure 46A:
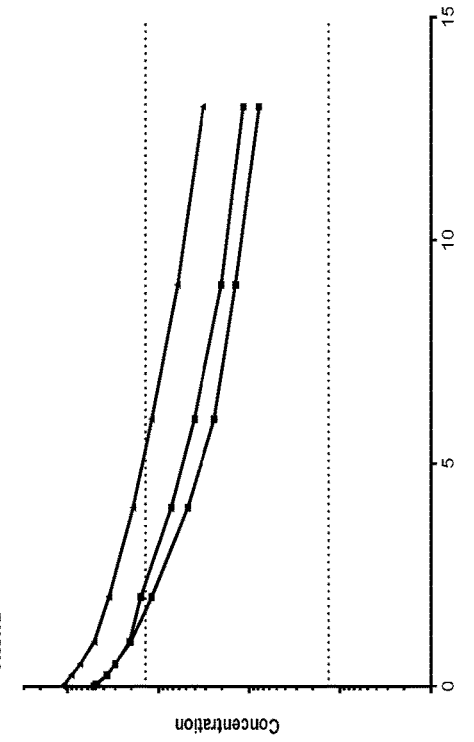
Figure 46C:
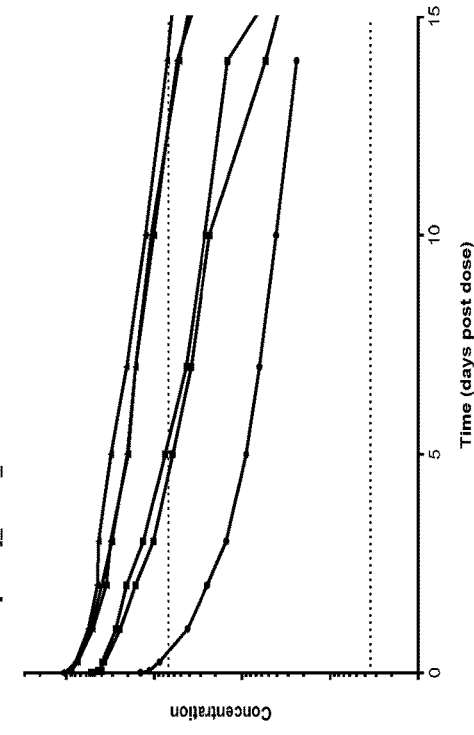
Figure 46B:
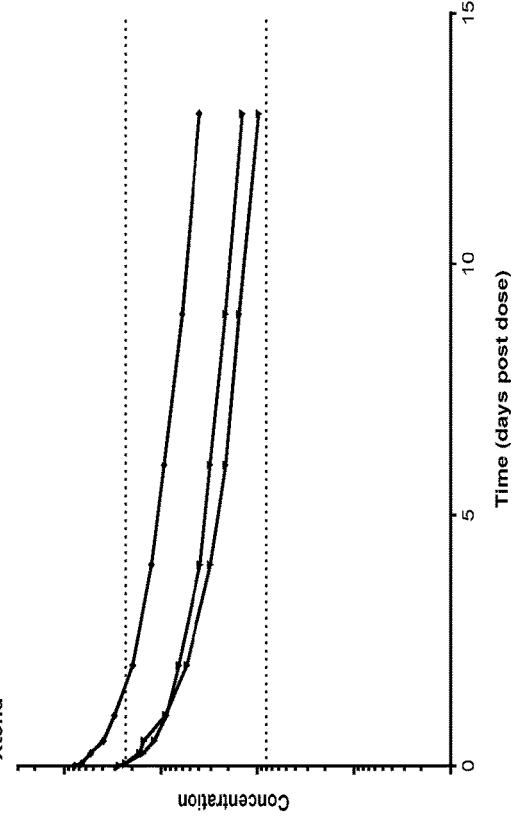
Figure 46D:
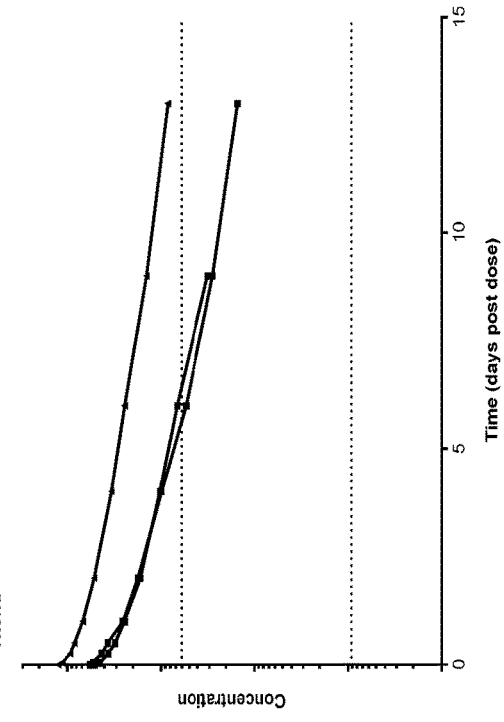
Figure 46E:
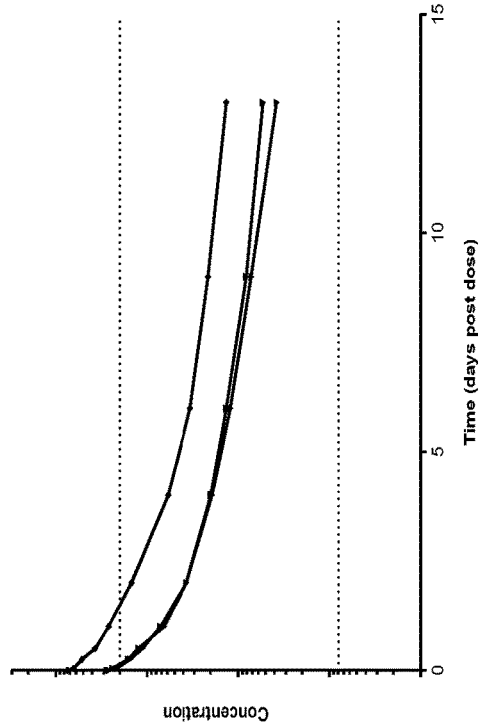
Figure 46F:
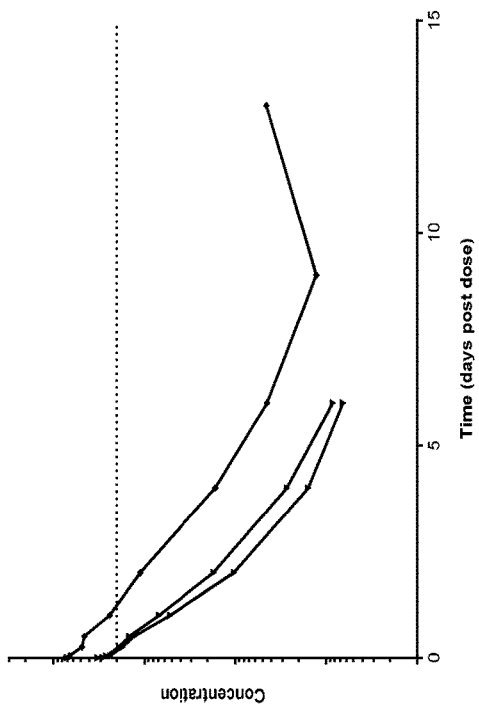
Figure 46G:
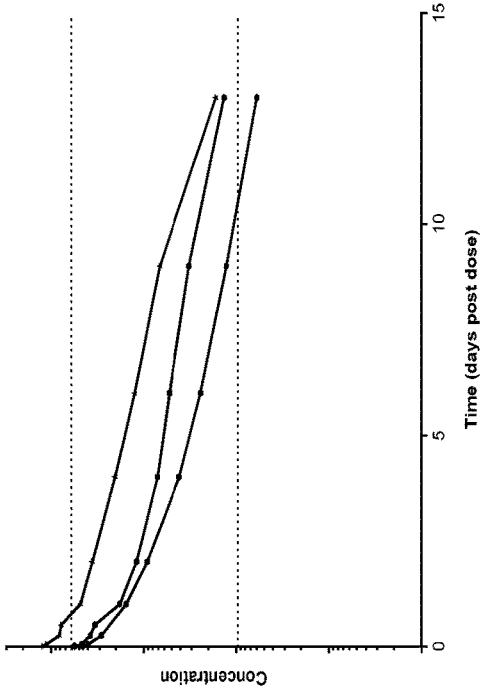
Figure 46H:
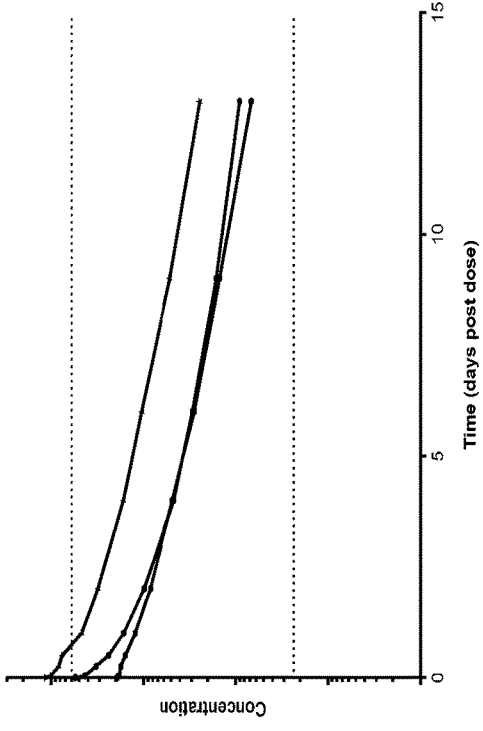

Additional B7H3×CD28 bsAbs were engineered with the various B7H3 binding domains (and it various formats) as described in Example 2 and pharmacokinetic profiles were investigated in another cynomolgus study. FIG. 46A-C depicts a comparison XENP34398, XENP37808 and XENP37810, each of which are bsAbs in the 2+1 CLC format. XENP34398 and XENP37810 have the same CD28 binding domain (1A7_H1.14_L1 Fab) but different affinity B7H3 binding domains (based on the same phage-derived clone, but the variant in XENP34398 had higher affinity B7H3 binding than the variant in XENP37810). XENP34398 and XENP37808 have the same B7H3 binding domain (2E4A3.189_H1.22_1A7_L1) but different affinity CD28 binding domains (based on 1A7, but the variant in XENP34398 had tighter binding affinity than the variant in XENP37808). FIG. 46D-F depicts a comparison of XENP34732, XENP35151, and XENP35153, each of which are bsAbs in the 1+1 Fab-scFv-Fc format and having the same CD28 binding domain (1A7_H1.14_L1 scFv) but different B7H3 binding domains (respectively, 6A1, 4F12, and 38E2). The data show that each of the 3 molecules having different B7H3 binding domains had differing PK profiles despite being otherwise identical. In particular, XENP35151 (having 4F12 binding domain which as described in Example 2B has much tighter binding affinity than either 6A1 and 38E2) demonstrated worse PK profile in comparison to both XENP34732 and XENP35153 (respectively having 6A1 and 38E2 binding domains). This suggests that at least in the 1+1 format, the binding affinity for B7H3 may impact pharmacokinetic profile. FIGS. 46G-H depicts comparison of XENP37807 and XENP37982, each of which are bsAbs in the 2+1 mAb-scFv format and having the same CD28 binding domain (1A7_H1.14_L1 scFv) but different B7H3 binding domains (respectively 2E4 and 3C4).

4C: Summary of Select B7H3×CD28 bsAbs

FIG. 47 depicts a summary of properties of several of the B7H3×CD28 bsAbs of the invention. It should be noted that some of the data depicted in this summary table may not be the same experimental data depicted elsewhere in the Working Examples as some of those illustrate experimental data from earlier stages of development.

Example 5: Additional Characterization of Illustrative B7H3×CD28 Bispecific Antibodies Illustrative B7H3×CD28 bsAbs XENP34339 (or Xtend analog XENP34398) and XENP35612 (or Xtend analog XENP37808) were further characterized to generally demonstrate useful properties of the B7H3×CD28 bispecific antibodies of the invention.

5A: XENP34339 Restores CD28 Signaling

CTLA-4 is an immune checkpoint receptor that competes with CD28 for CD28 ligands CD80 and CD86; therefore, in the presence of CTLA-4 (as would be found in the tumor environment), CD28 signaling is dampened. Restoration of CD28 signaling by the CD28 bispecific antibodies of the invention were investigated in a mixed lymphocyte reaction. 100,000 CD3+ T cells were incubated with 10,000 dendritic cells (STEMCELL Technologies, Vancouver, Canada) having high B7H3 expression and 1 μg/mL CTLA-4-Fc were treated with a dose titration of B7H3×CD28 bispecific antibody XENP34339. 3 days post T cell seeding, cytokines were measured using MSD assay. The data as depicted in FIG. 48 show that XENP34339 enables endogenous CD28 signaling levels (i.e. absent introduced blockade by CTLA-4-Fc).

5B: XENP34339 Combines Productively with PD-1 Blockade

Checkpoint blockade (e.g. PD-1 blockade) may be a useful therapeutic modality to stack with engagement of T cell costimulatory receptors on TILs with agonistic antibodies as it would provide broad utility in solid tumors and circumvent CTLA4 inhibition of CD28 pathway. Accordingly, the combination of B7H3×CD28 bispecific antibodies XENP34339 and XENP34389 with XENP16432 (a bivalent anti-PD-1 mAb based on the variable regions of nivolumab; sequences depicted in FIG. 17) was investigated. 10,000 MDA-MB-231 cancer cells were treated with 100 ng/ml HLA-A2*0201 restricted CMV pp65 (NLVPMVATV) peptide (NLV peptide) overnight. The following day, 100,000 CD3 enriched cells from a CMV+ donor were added along with XENP16432 (PD-1 blockade; 10 μg/ml), XENP34339 (B7H3×CD28 in 2+1 CLC format with B7H3 binding domain based on 2E4A3.189 and CD28 binding domain based on 1A7; 1 μg/ml), XENP34389 (B7H3×CD28 in 2+1 Fab$_2$-scFv-Fc format with B7H3 binding domain based on 6A1 and CD28 binding domain based on 1A7; 1 μg/ml), and combinations of the B7H3×CD28 with XENP16432. 1 day after treatment, cell supernatant was assayed for cytokines using MSD assay (data for which are shown in FIG. 50 for experiments using CD3+ T cells from 2 different donors). The data show that incubation with XENP34339 alone induced cytokine release from T cells and combined synergistically with PD-1 blockade to enhance cytokine release. Notably, XENP34389 (2+1 Fab$_2$-scFv-Fc format) did not combine synergistically with PD-1 blockade. In a similar experiment, 20,000 MCF7 cancer cells were seeded in the presence of 100 ng/mL NLV peptide. After 24 hours, 200,000 CD3+ T cells (10:1 E:T) isolated from a CMV+PBMC donor and the test articles (PBS control, XENP34339 alone, PD-1 mAb XENP16432 alone, or XENP34339+ XENP16432) were added. After 6 days, cells were assessed via flow cytometry. Consistent with the above, the data depicted in FIG. 51 PD-1 blockade enhances expansion of NLV-tetramer positive CD8$^+$ T cells by XENP34339.

To investigate whether the difference observed for XENP34339 resulted from the difference in B7H3 binding domain or the difference in bispecific antibody format, the component binding domains of XENP34339 and XENP34389 were biophysically characterized using Octet. In a first experiment to determine the binding affinities of 2E4A3.189 and 6A1 for B7H3 antigen, XENP34339 and XENP34389 were reformatted to monovalently bind to B7H3 antigen (respectively as XENP34717 and XENP34728, sequences for which are depicted in FIGS. 37 and 36). Anti-mouse Fc biosensors were used to capture mouse Fc fusions of B7H3, either the full extracellular V1C1-V2V2 domain or the individual V1C1 or V2C2 domains, and dipped into multiple concentrations of XENP34717 or XENP34728. Kinetic analyses were performed by global fitting of binding data with a 1:1 Langmuir binding model. The resulting dissociation constant ($K_D$) are depicted in FIG. 52, and the data show that the 6A1 binding domain provided slightly tighter binding to B7H3 than the 2E4A3.189. Next, the binding affinities of the CD28 binding domains for CD28 antigen in the 2+1 CLC format and the 2+1 Fab$_2$-scFv-Fc format was investigated. Anti-HIS capture (HIS1K) biosensors were used to capture CD28-Fc-His protein and dipped into multiple concentrations of XENP34339 or XENP34389. Kinetic analyses were performed by global fitting of binding data with a 1:1 Langmuir binding model as well as steady state model. The resulting dissociation constant (KD) are depicted in FIG. 53. The data show that the 2+1 CLC format enabled much tighter binding to CD28 antigen than the 2+1 Fab$_2$-scFc-Fc format. Collectively, the data suggests that the differences observed in the activity of XENP34339 and XENP34389 were due to the differences in bispecific antibody format.

5C: XENP34339 Overcomes Cancer Cell Resistance to CD3 Bispecifics at Low Effector to Target Ratios It has been reported in literature that non-inflamed, cold tumors such as prostate cancer have low effector:target ratio. Accordingly, cell kill at a 1:1 effector:target was assessed using xCELLigence Real Time Cell Analysis instrument (ACEA Biosciences, San Diego, Calif.). 2,500 LNCaP cancer cells were first seeded. After 48 hours, freshly enriched CD3+ T cells were added along with an effector:target of 1:1 were added along with antibodies (αPSMA×αCD3 XENP31602 alone or XENP31602 in combination with XENP34339; sequences for XENP31602 are depicted in FIG. 54) at the indicated concentrations. Cell kill was recorded for 5 days post T cell seeding. The data as depicted in FIG. 55 show that XENP31602 alone struggled to enhance cell kill in comparison to incubation of cancer and T cells alone indicating that there is a resistance to the CD3 bispecific at the low 1:1 effector to target ratio.

Notably, addition of B7H3×CD28 overcomes cancer cell resistance to the CD3 bispecific. Although this experiment utilized a PSMA×CD3 bispecific antibody, it is reasonable to expect a similar outcome in combining the B7H3×CD28 bispecific antibodies of the invention with other CD3 bispecific antibodies including those utilizing the CD3 binding domains depicted in FIG. 56.

5D: XENP34339 Combines with PSMA×CD3 Bispecifics to Enhance Activity Only in the Presence of Both B7H3 and PSMA 10,000 cancer cells (LNCaP [PSMA+B7H3+], 22RV1 [PSMA+B7H3+], SKOV-3 [PSMA−B7H3+], or OVCAR-8 [PSMA−B7H3+]) were first seeded. The following day, freshly enriched CD3+ T cells were added at an effector: target ratio of 1:1 with 1 µg/ml XENP34339 in combination with a dose titration of an illustrative CD3 bispecific (αPSMA×αCD3 XENP31602). One day post T cell seeding, cytokines were measure using MSD assay and CD3+ T cells were counted using flow cytometry, data for which are depicted in FIGS. 57-60. The data show that the CD3 bispecific XENP31602 alone induced little to no T cell activity and proliferation at the low 1:1 effector:target ratio. However in the presence of LNCaP and 22Rv1 which are PSMA+B7H3+, the addition of αB7H3ΔαCD28 XENP34339 enhances the activity of αPSMA×αCD3 XENP31602. Notably, however, in the presence of SKOV-2 and OVCAR-8 which are PSMA−B7H3+, the addition of XENP343398 does not enhance activity. This requirement for both the tumor antigen associated with the CD28 bispecific antibody and the tumor antigen associated with the CD3 bispecific creates an AND gate useful for selectively targeting immune response to tumor cells which are more likely to co-express multiple tumor-associated antigens. This synergistic AND gate may also enable activity on tumors having lower target densities wherein the tumor cells may express multiple tumor-associated antigens albeit at low densities.

5E: Combining XENP34339 or XENP35612 with CD3 Bispecific Antibodies Increase Anti-Tumor Activity In Vivo In an in vivo study, NSG mice were engrafted intradermally with 2×10$^6$ pp-65 expressing MDA-MB-231 cells in the right flank on Day −23. On Day −1, mice were engrafted intraperitoneally with 5×10$^6$ human PBMCs. Mice were then treated on Days 0, 8, 14, 21, and 28 with a first illustrative B7H3×CD3 bispecific antibody (CD3bsAb1) (0.5 mg/kg) alone, a second illustrative B7H3×CD3 bispecific antibody (CD3bsAb2) (0.5 mg/kg) alone, or a combination of XENP34339 (5.0 mg/kg) with CD3bsAb1 or CD3bsAb2. Tumor volumes were monitored by caliper measurements, data for which are shown (days post 1' dose) in FIGS. 61-62. Blood was drawn once per week to investigate lymphocyte expansion, data for which are depicted in FIG. 63 for CD45+ cells on Day 14. The data shows that adding CD28 costimulation to a CD3 bispecific increases anti-tumor activity in vivo. Notably, CD28 costimulation enables up to a 600-fold increase in lymphocyte expansion.

In another in vivo study, NSG mice that were MHC I/II-DKO (NSG-DKO) and thus resistant to GVHD and another CD3 bispecific (a PSMA×CD3 were used. On Day −7, NSG-DKO mice were inoculated with 5×10$^6$ 22RV1 tumor cells each. On Day 0, mice were engrafted with 5×10$^6$ human PBMC cells from a random donor. Mice were then intraperitoneally treated on Days 0, 7, 14, and 21 with low or high concentration doses of illustrative PSMA×CD3 bispecific antibody XENP32220 (sequences as depicted in FIG. 54) alone or in combination with XENP34339. Blood and serum were drawn weekly. Treatment with both the CD3 and the CD28 bsAbs enhanced T cell expansion (as indicated by lymphocyte counts in FIG. 64A-C and specifically T cells expressing Ki67 proliferation marker in FIG. 64D-E) as well as T cell activation (as indicated by CD25 and PD1 expression on CD4$^+$ and CD8$^+$ T cells in FIG. 65) in comparison to treatment with the CD3 bsAb alone.

In another study, CD34+ Hu-NSG, which are NSG mice engrafted with human CD34+ hematopoietic stem cells so as to develop a functional human immune system with no reactivity towards the host were obtained from The Jackson Laboratory (Bar Harbor, Me.), were used. On Day −15, mice were intradermally inoculated with 4×10$^6$ pp65-MDA-MB231 cells. Mice were then treated intraperitoneally on Days 0, 7, and 14 with B7H3×CD3 bsAb alone, XENP35612 alone, B7H3×CD3 bsAb in combination with XENP35612, or B7H3×CD3 bsAb in combination with XENP34339. Tumor volumes were monitored by caliper measurements, data for which are shown (days post 1$^{st}$ dose) in FIGS. 66-67. Tumor was harvested on Day 23 to investigate expansion of tumor infiltrating lymphocytes, data for which are depicted in FIG. 68. The data show that XENP35612 combines well with CD3 bsAb to suppress tumor growth. Notably, combination of B7H3×CD28 with B7H3×CD3 enables significantly enhanced anti-tumor activity in comparison to treatment with B7H3×CD3 alone at earlier time points (i.e. days 6 and 9). Additionally, XENP35612 as a single agent significantly expands expansion of tumor infiltrating lymphocytes; and combination of XENP35612 and B7H3×CD3 bsAb significantly enhances expansion of tumor infiltrating lymphocytes in comparison to B7H3×CD3 bsAb alone.

5F: XENP34339 and XENP37808 are not Superagonistic

Potential superagonistic properties of XENP34339 and XENP37808 were assessed by air-drying per the Stebbings protocol (Stebbings R. et al. 2007). Air-drying of test articles was achieved by drying in a SpeedVac™ for 2 hours at room temperature. Human PBMCs were treated for 24 hours with 10 μg of air-dried XENP34339 or XENP37808, and activity was compared to the superagonist TGN1412 (XENP29154; sequences for which are depicted in FIG. 69) or PBS control. Airdried TGN1412 promoted IFNγ, IL-6, IL-2, and TNF cytokine secretion from unstimulated human PBMC. In comparison, the cytokine levels in PBMCs treated with air-dried XENP34339 and XENP37808 remained similar to the negative control of PBS (data shown in FIGS. 70-71).

5G: XENP37808 Enhances CD3 Activity of Both Human & Cynomolgus PBMC

In order to investigate whether or not cynomolgus would be a good model for toxicology studies, an experiment was performed in which PBMCs from 11 unique human donors or 12 unique cynomolgus donors are dosed with XENP37808 in the presence of HEK cells transfected with anti-CD3 scFv (to provide "Signal 1") at a 10:1 E:T ratio. After 1 or 5 days, IL-2 release was measured using MSD assay. The results as depicted in FIG. 72 (data from one human donor and one cynomolgus donor) verify that cynomolgus is a comparably relevant species. Additionally, HEK cells transfected with anti-CD3 scFv but with B7H3 expression knocked out were also tested. Consistent with the data in Example 5D, these results show that XENP37808 enhances CD3 activity of human PBMCs exclusively in the presence of B7H3.

5H: Additional In Vitro Comparison of XENP34398 and XENP37808

In a first set of experiments, 1,250 22RV1-NLR (having a MESF value of ~170K B7H3 antigens) or DU145-NLR cancer cells (having ~270K B7H3 antigens) were seeded per well. After 48 hrs, CD3+ T cells were added at an effector to target ratio of 1:1 with indicated amounts of B7H3×CD3 and 1 ug/mL B7H3×CD28, and cell counts were recorded by Incucyte. The results, shown in FIG. 73, demonstrate that in combination with a B7H3×CD3 bispecific, both XENP34398 and XENP37808 induce very similar levels of RTCC.

In an additional set of experiment 10,000 target cancer cells (OVCAR8 having ~20K B7H3 surface density; 22RV1-NLR having ~170K B7H3 antigen density; or DU145-NLR having ~270K B7H3 antigen density) per well were seeded. The next day T-cells at an effector to target ratio of 1:1 were added with indicated amounts of B7H3×CD28 mAb in the presence of 1 μg/mL of an illustrative B7H3×CD3 bsAb. IL-2 was assayed 24 hours after seeding. The results shown in FIG. 74 depict the very similar levels of function as measured by IL-2 induction of XENP34398 and XENP37808 on cell lines of various densities.

Together, these data show that both XENP37808 and XENP34398 display very similar activity and are equally efficacious. However, each may potentially have their own advantages in a clinical setting.

SEQUENCE LISTING (1200 sequences)

SEQ ID NO: 1 - protein, 121 aa, Artificial Sequence
  Description of Artificial Sequence: Synthetic polypeptide
  CD28.3[CD28]_H0L0 Variable heavy (vh) domain
EVKLQQSGAELVKPGASVRLSCKASGYTFTEYIIHWIKLRSGQGLEWIGWFYPGSNDIQYNAKFKGKATLTADKSSSTVYMELTGLTSEDSAVYFCARRDDFSGYDALPYWGQGTMVTVSS

SEQ ID NO: 2 - protein, 5 aa, Artificial Sequence
  Description of Artificial Sequence: Synthetic peptide
  CD28.3[CD28]_H0L0 vhCDR1
EYIIH

SEQ ID NO: 3 - protein, 17 aa, Artificial Sequence
  Description of Artificial Sequence: Synthetic peptide
  CD28.3[CD28]_H0L0 vhCDR2
WFYPGSNDIQYNAKFKG

SEQ ID NO: 4 - protein, 12 aa, Artificial Sequence
  Description of Artificial Sequence: Synthetic peptide
  CD28.3[CD28]_H0L0 vhCDR3
RDDFSGYDALPY

SEQ ID NO: 5 - protein, 107 aa, Artificial Sequence
  Description of Artificial Sequence: Synthetic polypeptide
  CD28.3[CD28]_H0L0 Variable light (vl) domain
DIQMTQSPASLSVSVGETVTITCRTNENIYSNLAWYQQKQGKSPQLLIYAATHLVEGVPSRFSGSGSGTQYSLKITSLQSEDFGNYYCQHFWGTPCTFGGGTKLEIK

SEQ ID NO: 6 - protein, 11 aa, Artificial Sequence
  Description of Artificial Sequence: Synthetic peptide
  CD28.3[CD28]_H0L0 vlCDR1
RTNENIYSNLA

SEQ ID NO: 7 - protein, 7 aa, Artificial Sequence
  Description of Artificial Sequence: Synthetic peptide
  CD28.3[CD28]_H0L0 vlCDR2
AATHLVE

SEQ ID NO: 8 - protein, 9 aa, Artificial Sequence
  Description of Artificial Sequence: Synthetic peptide
  CD28.3[CD28]_H0L0 vlCDR3
QHFWGTPCT

SEQ ID NO: 9 - protein, 121 aa, Artificial Sequence
  Description of Artificial Sequence: Synthetic polypeptide
  hCD28.3[CD28]_H1L1 Variable heavy (vh) domain
QVQLQQSGAELKKPGASVKVSCKASGYTFTEYIIHWIKLRSGQGLEWIGWFYPGSNDIQYNAQFKGKATLTADKSSSTVYMELTGLTPEDSAVYFCARRDDFSGYDALPYWGQGTLVTVSA

SEQ ID NO: 10 - protein, 5 aa, Artificial Sequence
  Description of Artificial Sequence: Synthetic peptide
  hCD28.3[CD28]_H1L1 vhCDR1
EYIIH

SEQ ID NO: 11 - protein, 17 aa, Artificial Sequence
  Description of Artificial Sequence: Synthetic peptide
  hCD28.3[CD28]_H1L1 vhCDR2
WFYPGSNDIQYNAQFKG

SEQ ID NO: 12 - protein, 12 aa, Artificial Sequence
  Description of Artificial Sequence: Synthetic peptide
  hCD28.3[CD28]_H1L1 vhCDR3
RDDFSGYDALPY

SEQ ID NO: 13 - protein, 107 aa, Artificial Sequence
  Description of Artificial Sequence: Synthetic polypeptide
  hCD28.3[CD28]_H1L1 Variable light (vl) domain
DIQMTQSPSSLSASVGDRVTITCKTNENIYSNLAWYQQKDGKSPQLLIYAATHLVEGVPSRFSGSGSGTQYSLTISSLQPEDFGNYYCQHFWGTPCTFGGGTKLEIK

SEQ ID NO: 14 - protein, 11 aa, Artificial Sequence
  Description of Artificial Sequence: Synthetic peptide
  hCD28.3[CD28]_H1L1 vlCDR1
KTNENIYSNLA

SEQ ID NO: 15 - protein, 7 aa, Artificial Sequence
  Description of Artificial Sequence: Synthetic peptide
  hCD28.3[CD28]_H1L1 vlCDR2
AATHLVE

SEQ ID NO: 16 - protein, 9 aa, Artificial Sequence
  Description of Artificial Sequence: Synthetic peptide
  hCD28.3[CD28]_H1L1 vlCDR3
QHFWGTPCT

SEQ ID NO: 17 - protein, 120 aa, Artificial Sequence
  Description of Artificial Sequence: Synthetic polypeptide
  5.11A1[CD28]_H0L0 Variable heavy (vh) domain
QVQLQQSGPELVKPGTSVRISCEASGYTFTSYYIHWVKQRPGQGLEWIGCIYPGNVNTNYNEKFKDKATLIVDTSSNTAYMQLSRMTSEDSAVYFCTRSHYGLDWNFDVWGAGTTVTVSS

SEQ ID NO: 18 - protein, 5 aa, Artificial Sequence
  Description of Artificial Sequence: Synthetic peptide
  5.11A1[CD28]_H0L0 vhCDR1
SYYIH

SEQ ID NO: 19 - protein, 17 aa, Artificial Sequence
  Description of Artificial Sequence: Synthetic peptide
  5.11A1[CD28]_H0L0 vhCDR2
CIYPGNVNTNYNEKFKD

SEQ ID NO: 20 - protein, 11 aa, Artificial Sequence
  Description of Artificial Sequence: Synthetic peptide
  5.11A1[CD28]_H0L0 vhCDR3
SHYGLDWNFDV

SEQ ID NO: 21 - protein, 107 aa, Artificial Sequence
  Description of Artificial Sequence: Synthetic polypeptide
  5.11A1[CD28]_H0L0 Variable light (vl) domain
DIQMNQSPSSLSASLGDTITITCHASQNIYVWLNWYQQKPGNIPKLLIYKASNLHTGVPSRFSGSGSGTGFTLTISSLQPEDIATYYCQQGQTYPYTFGGGTKLEIK

SEQ ID NO: 22 - protein, 11 aa, Artificial Sequence
  Description of Artificial Sequence: Synthetic peptide
  5.11A1[CD28]_H0L0 vlCDR1
HASQNIYVWLN

SEQ ID NO: 23 - protein, 7 aa, Artificial Sequence
  Description of Artificial Sequence: Synthetic peptide
  5.11A1[CD28]_H0L0 vlCDR2
KASNLHT

SEQ ID NO: 24 - protein, 9 aa, Artificial Sequence
  Description of Artificial Sequence: Synthetic peptide
  5.11A1[CD28]_H0L0 vlCDR3
QQGQTYPYT

SEQ ID NO: 25 - protein, 120 aa, Artificial Sequence
  Description of Artificial Sequence: Synthetic polypeptide
  TGN1412_H1L1 Variable heavy (vh) domain
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSS

SEQ ID NO: 26 - protein, 5 aa, Artificial Sequence
  Description of Artificial Sequence: Synthetic peptide
  TGN1412_H1L1 vhCDR1
SYYIH

SEQ ID NO: 27 - protein, 17 aa, Artificial Sequence
  Description of Artificial Sequence: Synthetic peptide
  TGN1412_H1L1 vhCDR2
CIYPGNVNTNYNEKFKD

SEQ ID NO: 28 - protein, 11 aa, Artificial Sequence
  Description of Artificial Sequence: Synthetic peptide
  TGN1412_H1L1 vhCDR3
SHYGLDWNFDV

SEQ ID NO: 29 - protein, 107 aa, Artificial Sequence
  Description of Artificial Sequence: Synthetic polypeptide
  TGN1412_H1L1 Variable light (vl) domain
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIK

SEQ ID NO: 30 - protein, 11 aa, Artificial Sequence
  Description of Artificial Sequence: Synthetic peptide
  TGN1412_H1L1 vlCDR1
HASQNIYVWLN

SEQ ID NO: 31 - protein, 7 aa, Artificial Sequence
  Description of Artificial Sequence: Synthetic peptide
  TGN1412_H1L1 vlCDR2
KASNLHT

SEQ ID NO: 32 - protein, 9 aa, Artificial Sequence
  Description of Artificial Sequence: Synthetic peptide
  TGN1412_H1L1 vlCDR3
QQGQTYPYT

SEQ ID NO: 33 - protein, 127 aa, Artificial Sequence
  Description of Artificial Sequence: Synthetic polypeptide
  341VL34[CD28]_H1L1 Variable heavy (vh) domain
EVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSS

SEQ ID NO: 34 - protein, 5 aa, Artificial Sequence
  Description of Artificial Sequence: Synthetic peptide
  341VL34[CD28]_H1L1 vhCDR1
NAWMN

SEQ ID NO: 35 - protein, 19 aa, Artificial Sequence
  Description of Artificial Sequence: Synthetic peptide
  341VL34[CD28]_H1L1 vhCDR2
RIKGKTDGGTADYAAPVKG

SEQ ID NO: 36 - protein, 16 aa, Artificial Sequence
  Description of Artificial Sequence: Synthetic peptide
  341VL34[CD28]_H1L1 vhCDR3
DLPYYYGSGRYSGMDV

SEQ ID NO: 37 - protein, 104 aa, Artificial Sequence
  Description of Artificial Sequence: Synthetic polypeptide
  341VL34[CD28]_H1L1 Variable light (vl) domain
EIVLTQSPATLSLSPGERATLSCRASQSVSSYLAWYQQKPGQAPRLLIYDASNRATGIPARFSGSGSGTDFTLTISSLEPEDFAVYYCQQRSNTFGPGTKVDIK

SEQ ID NO: 38 - protein, 11 aa, Artificial Sequence
  Description of Artificial Sequence: Synthetic peptide
  341VL34[CD28]_H1L1 vlCDR1
RASQSVSSYLA

SEQ ID NO: 39 - protein, 7 aa, Artificial Sequence
  Description of Artificial Sequence: Synthetic peptide
  341VL34[CD28]_H1L1 vlCDR2
DASNRAT

SEQ ID NO: 40 - protein, 6 aa, Artificial Sequence
  Description of Artificial Sequence: Synthetic peptide
  341VL34[CD28]_H1L1 vlCDR3
QQRSNT

SEQ ID NO: 41 - protein, 127 aa, Artificial Sequence
  Description of Artificial Sequence: Synthetic polypeptide
  341VL36[CD28]_H1L1 Variable heavy (vh) domain
EVQLVESGGGLVKPGGSLRLSCGGSGFTFNNAWMNWVRQAPGKGLEWVGRIKGKTDGGTADYAAPVKGRFTISRDYSKNTLYLQMNSLKTEDTGVYYCTTYLPYYYGSERWSGMDVWGQGTTVTVSS

SEQ ID NO: 42 - protein, 5 aa, Artificial Sequence
  Description of Artificial Sequence: Synthetic peptide
  341VL36[CD28]_H1L1 vhCDR1
NAWMN

SEQ ID NO: 43 - protein, 19 aa, Artificial Sequence
  Description of Artificial Sequence: Synthetic peptide
  341VL36[CD28]_H1L1 vhCDR2
RIKGKTDGGTADYAAPVKG

SEQ ID NO: 44 - protein, 16 aa, Artificial Sequence
  Description of Artificial Sequence: Synthetic peptide
  341VL36[CD28]_H1L1 vhCDR3
YLPYYYGSERWSGMDV

SEQ ID NO: 45 - protein, 104 aa, Artificial Sequence; identical to SEQ ID NO: 37
  Description of Artificial Sequence: Synthetic polypeptide
  341VL36[CD28]_H1L1 Variable light (vl) domain

SEQ ID NO: 46 - protein, 11 aa, Artificial Sequence
  Description of Artificial Sequence: Synthetic peptide
  341VL36[CD28]_H1L1 vlCDR1
RASQSVSSYLA

SEQ ID NO: 47 - protein, 7 aa, Artificial Sequence
  Description of Artificial Sequence: Synthetic peptide
  341VL36[CD28]_H1L1 vlCDR2
DASNRAT

SEQ ID NO: 48 - protein, 6 aa, Artificial Sequence
  Description of Artificial Sequence: Synthetic peptide
  341VL36[CD28]_H1L1 vlCDR3
QQRSNT

SEQ ID NO: 49 - protein, 126 aa, Artificial Sequence
  Description of Artificial Sequence: Synthetic polypeptide
  281VL4[CD28]_H1L1 Variable heavy (vh) domain
EVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSS

SEQ ID NO: 50 - protein, 5 aa, Artificial Sequence
  Description of Artificial Sequence: Synthetic peptide
  281VL4[CD28]_H1L1 vhCDR1
SFAIS

SEQ ID NO: 51 - protein, 17 aa, Artificial Sequence
  Description of Artificial Sequence: Synthetic peptide
  281VL4[CD28]_H1L1 vhCDR2
GIIPIFGPANYAQKFQG

SEQ ID NO: 52 - protein, 17 aa, Artificial Sequence
  Description of Artificial Sequence: Synthetic peptide
  281VL4[CD28]_H1L1 vhCDR3
HAIAMGWGVITTNYFDS

SEQ ID NO: 53 - protein, 108 aa, Artificial Sequence
  Description of Artificial Sequence: Synthetic polypeptide
  281VL4[CD28]_H1L1 Variable light (vl) domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 54 - protein, 12 aa, Artificial Sequence
  Description of Artificial Sequence: Synthetic peptide
  281VL4[CD28]_H1L1 vlCDR1
RASQSVSSSYLA

SEQ ID NO: 55 - protein, 7 aa, Artificial Sequence
  Description of Artificial Sequence: Synthetic peptide
  281VL4[CD28]_H1L1 vlCDR2
GASSRAT

SEQ ID NO: 56 - protein, 9 aa, Artificial Sequence
  Description of Artificial Sequence: Synthetic peptide
  281VL4[CD28]_H1L1 vlCDR3
QQYGSSPIT

SEQ ID NO: 57 - protein, 121 aa, Artificial Sequence
  Description of Artificial Sequence: Synthetic polypeptide
  HuTN228[CD28]_H1L1 Variable heavy (vh) domain
QVQLQESGPGLVKPSETLSLTCAVSGFSLTSYGVHWIRQPPGKGLEWLGVIWPGGGTNFNSALMSRLTISEDTSKNQVSLKLSSVTAADTAVYYCARDRAYGNYLYAMDYWGQGTLVTVSS

SEQ ID NO: 58 - protein, 5 aa, Artificial Sequence
  Description of Artificial Sequence: Synthetic peptide
  HuTN228[CD28]_H1L1 vhCDR1
SYGVH

SEQ ID NO: 59 - protein, 16 aa, Artificial Sequence
  Description of Artificial Sequence: Synthetic peptide
  HuTN228[CD28]_H1L1 vhCDR2
VIWPGGGTNFNSALMS

SEQ ID NO: 60 - protein, 13 aa, Artificial Sequence
  Description of Artificial Sequence: Synthetic peptide
  HuTN228[CD28]_H1L1 vhCDR3
DRAYGNYLYAMDY

SEQ ID NO: 61 - protein, 111 aa, Artificial Sequence
  Description of Artificial Sequence: Synthetic polypeptide
  HuTN228[CD28]_H1L1 Variable light (vl) domain
DIQMTQSPSSLSASVGDRVTITCRASESVEYYVTSLMQWYQQKPGKAPKLLIYAASNVDSGVPSRFSGSGSGTDFTLTISSLQPEDIATYYCQQSRKVPFTFGGGTKVEIK

SEQ ID NO: 62 - protein, 15 aa, Artificial Sequence
  Description of Artificial Sequence: Synthetic peptide
  HuTN228[CD28]_H1L1 vlCDR1
RASESVEYYVTSLMQ

SEQ ID NO: 63 - protein, 7 aa, Artificial Sequence
  Description of Artificial Sequence: Synthetic peptide
  HuTN228[CD28]_H1L1 vlCDR2
AASNVDS

SEQ ID NO: 64 - protein, 9 aa, Artificial Sequence
  Description of Artificial Sequence: Synthetic peptide
  HuTN228[CD28]_H1L1 vlCDR3
QQSRKVPFT

SEQ ID NO: 65 - protein, 124 aa, Artificial Sequence
  Description of Artificial Sequence: Synthetic polypeptide
  PV1[CD28]_H0L0 Variable heavy (vh) domain
QVQLKQSGAELVKPGASVKISCKTSGYTFTDGYMNWVEQKPGQGLEWIGRIDPDSGNTRYNQKFQGKATLTRDKSSSTVYMDLRSLTSEDSAVYYCARDGTFYGTYGYWYFDFWGQGTQVTVSS

SEQ ID NO: 66 - protein, 5 aa, Artificial Sequence
  Description of Artificial Sequence: Synthetic peptide
  PV1[CD28]_H0L0 vhCDR1
DGYMN

SEQ ID NO: 67 - protein, 17 aa, Artificial Sequence
  Description of Artificial Sequence: Synthetic peptide
  PV1[CD28]_H0L0 vhCDR2
RIDPDSGNTRYNQKFQG

SEQ ID NO: 68 - protein, 15 aa, Artificial Sequence
  Description of Artificial Sequence: Synthetic peptide
  PV1[CD28]_H0L0 vhCDR3
DGTFYGTYGYWYFDF

SEQ ID NO: 69 - protein, 113 aa, Artificial Sequence
  Description of Artificial Sequence: Synthetic polypeptide
  PV1[CD28]_H0L0 Variable light (vl) domain
DIVMTQSPYSLAVSAGEKVTMSCRSSQSLYYSGIKKNLLAWYQQKPGQSPKLLIYFTSTRLPGVPDRFTGSGSGTDYTLTITSVQAEDMGHYFCQQGISTPLTFGDGTKLEIR

SEQ ID NO: 70 - protein, 17 aa, Artificial Sequence
  Description of Artificial Sequence: Synthetic peptide
  PV1[CD28]_H0L0 vlCDR1
RSSQSLYYSGIKKNLLA

SEQ ID NO: 71 - protein, 7 aa, Artificial Sequence
  Description of Artificial Sequence: Synthetic peptide
  PV1[CD28]_H0L0 vlCDR2
FTSTRLP

SEQ ID NO: 72 - protein, 9 aa, Artificial Sequence
  Description of Artificial Sequence: Synthetic peptide
  PV1[CD28]_H0L0 vlCDR3
QQGISTPLT

SEQ ID NO: 73 - protein, 120 aa, Artificial Sequence
  Description of Artificial Sequence: Synthetic polypeptide
  m9.3[CD28]_H0L0 Variable heavy (vh) domain
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSS

SEQ ID NO: 74 - protein, 5 aa, Artificial Sequence
  Description of Artificial Sequence: Synthetic peptide
  m9.3[CD28]_H0L0 vhCDR1
DYGVH

SEQ ID NO: 75 - protein, 16 aa, Artificial Sequence
  Description of Artificial Sequence: Synthetic peptide
  m9.3[CD28]_H0L0 vhCDR2
VIWAGGGTNYNSALMS

SEQ ID NO: 76 - protein, 12 aa, Artificial Sequence
  Description of Artificial Sequence: Synthetic peptide
  m9.3[CD28]_H0L0 vhCDR3
DKGYSYYYSMDY

SEQ ID NO: 77 - protein, 111 aa, Artificial Sequence
  Description of Artificial Sequence: Synthetic polypeptide
  m9.3[CD28]_H0L0 Variable light (vl) domain
DIELTQSPASLAVSLGQRATISCRASESVEYYVTSLMQWYQQKPGQPPKLLIFAASNVESGVPARFSGSGSGTNFSLNIHPVDEDDVAMYFCQQSRKVPYTFGGGTKLEIK

SEQ ID NO: 78 - protein, 15 aa, Artificial Sequence
  Description of Artificial Sequence: Synthetic peptide
  m9.3[CD28]_H0L0 vlCDR1
RASESVEYYVTSLMQ

SEQ ID NO: 79 - protein, 7 aa, Artificial Sequence
  Description of Artificial Sequence: Synthetic peptide
  m9.3[CD28]_H0L0 vlCDR2
AASNVES

SEQ ID NO: 80 - protein, 9 aa, Artificial Sequence
  Description of Artificial Sequence: Synthetic peptide
  m9.3[CD28]_H0L0 vlCDR3
QQSRKVPYT

SEQ ID NO: 81 - protein, 120 aa, Artificial Sequence
  Description of Artificial Sequence: Synthetic polypeptide
  hu9.3[CD28]_H1L1 Variable heavy (vh) domain
EVQLVQSGGGLVQPGGSLRLSCAGSGFTFSDYGVHWVRQAPGKGLEWVSAIWAGGGTNYASSVMGRFTISRDNAKNSLYLQMNSLRAEDMAVYYCARDKGYSYYYSMDYWGQGTLVTVSS

SEQ ID NO: 82 - protein, 5 aa, Artificial Sequence
  Description of Artificial Sequence: Synthetic peptide
  hu9.3[CD28]_H1L1 vhCDR1
DYGVH

SEQ ID NO: 83 - protein, 16 aa, Artificial Sequence
  Description of Artificial Sequence: Synthetic peptide
  hu9.3[CD28]_H1L1 vhCDR2
AIWAGGGTNYASSVMG

SEQ ID NO: 84 - protein, 12 aa, Artificial Sequence
  Description of Artificial Sequence: Synthetic peptide
  hu9.3[CD28]_H1L1 vhCDR3
DKGYSYYYSMDY

SEQ ID NO: 85 - protein, 111 aa, Artificial Sequence
  Description of Artificial Sequence: Synthetic polypeptide
  hu9.3[CD28]_H1L1 Variable light (vl) domain
DIVMTQSPDSLAVSLGERATINCRASESVEYYVTSLMAWYQQKPGQPPKLLIYAASNVESGVPDRFSGSGSGTNFSLTISSLQAEDVAVYYCQQSRKVPYTFGQGTKLEIK

SEQ ID NO: 86 - protein, 15 aa, Artificial Sequence
  Description of Artificial Sequence: Synthetic peptide
  hu9.3[CD28]_H1L1 vlCDR1
RASESVEYYVTSLMA

SEQ ID NO: 87 - protein, 7 aa, Artificial Sequence
  Description of Artificial Sequence: Synthetic peptide
  hu9.3[CD28]_H1L1 vlCDR2
AASNVES

SEQ ID NO: 88 - protein, 9 aa, Artificial Sequence
  Description of Artificial Sequence: Synthetic peptide
  hu9.3[CD28]_H1L1 vlCDR3
QQSRKVPYT

SEQ ID NO: 89 - protein, 120 aa, Artificial Sequence
  Description of Artificial Sequence: Synthetic polypeptide
  omburtamab Variable heavy (vh) domain
VHQVQLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTLVTVSA

SEQ ID NO: 90 - protein, 5 aa, Artificial Sequence
  Description of Artificial Sequence: Synthetic peptide
  omburtamab vhCDR1
NYDIN

SEQ ID NO: 91 - protein, 17 aa, Artificial Sequence
  Description of Artificial Sequence: Synthetic peptide
  omburtamab vhCDR2
WIFPGDGSTQYNEKFKG

SEQ ID NO: 92 - protein, 9 aa, Artificial Sequence
  Description of Artificial Sequence: Synthetic peptide
  omburtamab vhCDR3
QTTATWFAY

SEQ ID NO: 93 - protein, 109 aa, Artificial Sequence
  Description of Artificial Sequence: Synthetic polypeptide
  omburtamab Variable light (vl) domain
VLDIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 94 - protein, 11 aa, Artificial Sequence
  Description of Artificial Sequence: Synthetic peptide
  omburtamab vlCDR1
RASQSISDYLH

SEQ ID NO: 95 - protein, 7 aa, Artificial Sequence
  Description of Artificial Sequence: Synthetic peptide
  omburtamab vlCDR2
YASQSIS

SEQ ID NO: 96 - protein, 9 aa, Artificial Sequence
  Description of Artificial Sequence: Synthetic peptide
  omburtamab vlCDR3
QNGHSFPLT

SEQ ID NO: 97 - protein, 124 aa, Artificial Sequence
  Description of Artificial Sequence: Synthetic polypeptide
  enoblituzumab Variable heavy (vh) domain
VHEVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSS

SEQ ID NO: 98 - protein, 5 aa, Artificial Sequence
  Description of Artificial Sequence: Synthetic peptide
  enoblituzumab vhCDR1
SFGMH

SEQ ID NO: 99 - protein, 17 aa, Artificial Sequence
  Description of Artificial Sequence: Synthetic peptide
  enoblituzumab vhCDR2
YISSDSSAIYYADTVKG

SEQ ID NO: 100 - protein, 13 aa, Artificial Sequence
  Description of Artificial Sequence: Synthetic peptide
  enoblituzumab vhCDR3
GRENIYYGSRLDY

SEQ ID NO: 101 - protein, 109 aa, Artificial Sequence
  Description of Artificial Sequence: Synthetic polypeptide
  enoblituzumab Variable light (vl) domain
VLDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 102 - protein, 11 aa, Artificial Sequence
  Description of Artificial Sequence: Synthetic peptide
  enoblituzumab vlCDR1
KASQNVDTNVA

SEQ ID NO: 103 - protein, 7 aa, Artificial Sequence
  Description of Artificial Sequence: Synthetic peptide
  enoblituzumab vlCDR2
SASYRYS

SEQ ID NO: 104 - protein, 9 aa, Artificial Sequence
  Description of Artificial Sequence: Synthetic peptide
  enoblituzumab vlCDR3
QQYNNYPFT

SEQ ID NO: 105 - protein, 124 aa, Artificial Sequence
  Description of Artificial Sequence: Synthetic polypeptide
  BRCA84D Variable heavy (vh) domain
VHDVQLVESGGGLVQPGGSRKLSCAASGFTFSSFGMHWVRQAPEKGLEWVAYISSDSSAIYYADTVKGRFTISRDNPKNTLFLQMTSLRSEDTAMYYCGRGRENIYYGSRLDYWGQGTTLTVSS

SEQ ID NO: 106 - protein, 5 aa, Artificial Sequence
  Description of Artificial Sequence: Synthetic peptide
  BRCA84D vhCDR1
SFGMH

SEQ ID NO: 107 - protein, 17 aa, Artificial Sequence
  Description of Artificial Sequence: Synthetic peptide
  BRCA84D vhCDR2
YISSDSSAIYYADTVKG

SEQ ID NO: 108 - protein, 13 aa, Artificial Sequence
  Description of Artificial Sequence: Synthetic peptide
  BRCA84D vhCDR3
GRENIYYGSRLDY

SEQ ID NO: 109 - protein, 109 aa, Artificial Sequence
  Description of Artificial Sequence: Synthetic polypeptide
  BRCA84D Variable light (vl) domain
VLDIAMTQSQKFMSTSVGDRVSVTCKASQNVDTNVAWYQQKPGQSPKALIYSASYRYSGVPDRFTGSGSGTDFTLTINNVQSEDLAEYFCQQYNNYPFTFGSGTKLEIK

SEQ ID NO: 110 - protein, 11 aa, Artificial Sequence
  Description of Artificial Sequence: Synthetic peptide
  BRCA84D vlCDR1
KASQNVDTNVA

SEQ ID NO: 111 - protein, 7 aa, Artificial Sequence
  Description of Artificial Sequence: Synthetic peptide
  BRCA84D vlCDR2
SASYRYS

SEQ ID NO: 112 - protein, 9 aa, Artificial Sequence
  Description of Artificial Sequence: Synthetic peptide
  BRCA84D vlCDR3
QQYNNYPFT

SEQ ID NO: 113 - protein, 122 aa, Artificial Sequence
  Description of Artificial Sequence: Synthetic polypeptide
  BRCA69D Variable heavy (vh) domain
VHQVQLQQSGAELARPGASVKLSCKASGYTFTSYWMQWVKQRPGQGLEWIGTIYPGDGDTRYTQKFKGKATLTADKSSSTAYMQLSSLASEDSAVYYCARRGIPRLWYFDVWGAGTTVTVSS

SEQ ID NO: 114 - protein, 5 aa, Artificial Sequence
  Description of Artificial Sequence: Synthetic peptide
  BRCA69D vhCDR1
SYWMQ

SEQ ID NO: 115 - protein, 17 aa, Artificial Sequence
  Description of Artificial Sequence: Synthetic peptide
  BRCA69D vhCDR2
TIYPGDGDTRYTQKFKG

SEQ ID NO: 116 - protein, 11 aa, Artificial Sequence
  Description of Artificial Sequence: Synthetic peptide
  BRCA69D vhCDR3
RGIPRLWYFDV

SEQ ID NO: 117 - protein, 109 aa, Artificial Sequence
  Description of Artificial Sequence: Synthetic polypeptide
  BRCA69D Variable light (vl) domain
VLDIQMTQTTSSLSASLGDRVTISCRASQDISNYLNWYQQKPDGTVKLLIYYTSRLHSGVPSRFSGSGSGTDYSLTIDNLEQEDIATYFCQQGNTLPPTFGGGTKLEIK

SEQ ID NO: 118 - protein, 11 aa, Artificial Sequence
  Description of Artificial Sequence: Synthetic peptide
  BRCA69D vlCDR1
RASQDISNYLN

SEQ ID NO: 119 - protein, 7 aa, Artificial Sequence
  Description of Artificial Sequence: Synthetic peptide
  BRCA69D vlCDR2
YTSRLHS

SEQ ID NO: 120 - protein, 9 aa, Artificial Sequence
  Description of Artificial Sequence: Synthetic peptide
  BRCA69D vlCDR3
QQGNTLPPT

SEQ ID NO: 121 - protein, 119 aa, Artificial Sequence
  Description of Artificial Sequence: Synthetic polypeptide
  PRCA157 Variable heavy (vh) domain
VHEVQQVESGGDLVKPGGSLKLSCAASGFTFSSYGMSWVRQTPDKRLEWVATINSGGSNTYYPDSLKGRFTISRDNAKNTLYLQMRSLKSEDTAMYYCARHDGGAMDYWGQGTSVTVSS

SEQ ID NO: 122 - protein, 5 aa, Artificial Sequence
  Description of Artificial Sequence: Synthetic peptide
  PRCA157 vhCDR1
SYGMS

SEQ ID NO: 123 - protein, 17 aa, Artificial Sequence
  Description of Artificial Sequence: Synthetic peptide
  PRCA157 vhCDR2
TINSGGSNTYYPDSLKG

SEQ ID NO: 124 - protein, 8 aa, Artificial Sequence
  Description of Artificial Sequence: Synthetic peptide
  PRCA157 vhCDR3
HDGGAMDY

SEQ ID NO: 125 - protein, 110 aa, Artificial Sequence
  Description of Artificial Sequence: Synthetic polypeptide
  PRCA157 Variable light (vl) domain
VLDIQMTQSPASLSVSVGETVTITCRASESIYSYLAWYQQKQGKSPQLLVYNTKTLPEGVPSRFSGSGSGTQFSLKINSLQPEDFGRYYCQHHYGTPPWTFGGGTNLEIK

SEQ ID NO: 126 - protein, 11 aa, Artificial Sequence
  Description of Artificial Sequence: Synthetic peptide
  PRCA157 vlCDR1
RASESIYSYLA

SEQ ID NO: 127 - protein, 7 aa, Artificial Sequence
  Description of Artificial Sequence: Synthetic peptide
  PRCA157 vlCDR2
NTKTLPE

SEQ ID NO: 128 - protein, 10 aa, Artificial Sequence
  Description of Artificial Sequence: Synthetic peptide
  PRCA157 vlCDR3
QHHYGTPPWT

SEQ ID NO: 129 - protein, 119 aa, Artificial Sequence
  Description of Artificial Sequence: Synthetic polypeptide
  huPRCA157 Variable heavy (vh) domain
VHEVQLVESGGGLVKPGGSLRLSCAASGFTFSSYGMSWVRQAPGKGLEWVATINSGGSNTYYPDSLKGRFTISRDNAKNSLYLQMNSLRAEDTAVYYCARHDGGAMDYWGQGTTVTVSS

SEQ ID NO: 130 - protein, 5 aa, Artificial Sequence
  Description of Artificial Sequence: Synthetic peptide
  huPRCA157 vhCDR1
SYGMS

SEQ ID NO: 131 - protein, 17 aa, Artificial Sequence
  Description of Artificial Sequence: Synthetic peptide
  huPRCA157 vhCDR2
TINSGGSNTYYPDSLKG

SEQ ID NO: 132 - protein, 8 aa, Artificial Sequence
  Description of Artificial Sequence: Synthetic peptide
  huPRCA157 vhCDR3
HDGGAMDY

SEQ ID NO: 133 - protein, 110 aa, Artificial Sequence
  Description of Artificial Sequence: Synthetic polypeptide
  huPRCA157 Variable light (vl) domain
VLDIQMTQSPSSLSASVGDRVTITCRASESIYSYLAWYQQKPGKAPKLLVYNTKTLPEGVPSRFSGSGSGTDFTLTISSLQPEDFATYYCQHHYGTPPWTFGQGTRLEIK

SEQ ID NO: 134 - protein, 11 aa, Artificial Sequence
  Description of Artificial Sequence: Synthetic peptide
  huPRCA157 vlCDR1
RASESIYSYLA

SEQ ID NO: 135 - protein, 7 aa, Artificial Sequence
  Description of Artificial Sequence: Synthetic peptide
  huPRCA157 vlCDR2
NTKTLPE

SEQ ID NO: 136 - protein, 10 aa, Artificial Sequence
  Description of Artificial Sequence: Synthetic peptide
  huPRCA157 vlCDR3
QHHYGTPPWT

SEQ ID NO: 137 - protein, 121 aa, Artificial Sequence
  Description of Artificial Sequence: Synthetic polypeptide
  mAb-D Variable heavy (vh) domain
VHDVQLAESGGGLVQPGGSRKLSCAASGFTFSSFGMHWVRQAPEKGLEWVAYISSGSGTIYYADTVKGRFTISRDNPKNSLFLQMTSLRSEDTAMYYCARHGYRYEGFDYWGQGTTLTVSS

SEQ ID NO: 138 - protein, 5 aa, Artificial Sequence
  Description of Artificial Sequence: Synthetic peptide
  mAb-D vhCDR1
SFGMH

SEQ ID NO: 139 - protein, 17 aa, Artificial Sequence
  Description of Artificial Sequence: Synthetic peptide
  mAb-D vhCDR2
YISSGSGTIYYADTVKG

SEQ ID NO: 140 - protein, 10 aa, Artificial Sequence
  Description of Artificial Sequence: Synthetic peptide
  mAb-D vhCDR3
HGYRYEGFDY

SEQ ID NO: 141 - protein, 109 aa, Artificial Sequence
  Description of Artificial Sequence: Synthetic polypeptide
  mAb-D Variable light (vl) domain
VLDIVMTQSQKFMSTSVGDRVSVTCKASQNVDTNVAWYQQKQGHSPEALIYSASYRYSGVPARFTGSGSGTDFTLTISNVQSEDLAEYFCQQYNNYPFTFGGGTKLEIK

SEQ ID NO: 142 - protein, 11 aa, Artificial Sequence
  Description of Artificial Sequence: Synthetic peptide
  mAb-D vlCDR1
KASQNVDTNVA

SEQ ID NO: 143 - protein, 7 aa, Artificial Sequence
  Description of Artificial Sequence: Synthetic peptide
  mAb-D vlCDR2
SASYRYS

SEQ ID NO: 144 - protein, 9 aa, Artificial Sequence
  Description of Artificial Sequence: Synthetic peptide
  mAb-D vlCDR3
QQYNNYPFT

SEQ ID NO: 145 - protein, 121 aa, Artificial Sequence
  Description of Artificial Sequence: Synthetic polypeptide
  humAb-D Variable heavy (vh) domain
VHEVQLVESGGGLVQPGGSLRLSCAASGFTFSSFGMHWVRQAPGKGLEWVAYISSGSGTIYYADTVKGRFTISRDNAKNSLYLQMNSLRAEDTAVYYCARHGYRYEGFDYWGQGTTVTVSS

SEQ ID NO: 146 - protein, 5 aa, Artificial Sequence
  Description of Artificial Sequence: Synthetic peptide
  humAb-D vhCDR1
SFGMH

SEQ ID NO: 147 - protein, 17 aa, Artificial Sequence
  Description of Artificial Sequence: Synthetic peptide
  humAb-D vhCDR2
YISSGSGTIYYADTVKG

SEQ ID NO: 148 - protein, 10 aa, Artificial Sequence
  Description of Artificial Sequence: Synthetic peptide
  humAb-D vhCDR3
HGYRYEGFDY

SEQ ID NO: 149 - protein, 109 aa, Artificial Sequence
  Description of Artificial Sequence: Synthetic polypeptide
  humAb-D Variable light (vl) domain
VLDIQMTQSPSFLSASVGDRVTITCKASQNVDTNVAWYQQKPGKAPKALIYSASYRYSGVPSRFSGSGSGTDFTLTISSLQPEDFAEYFCQQYNNYPFTFGQGTKLEIK

SEQ ID NO: 150 - protein, 11 aa, Artificial Sequence
  Description of Artificial Sequence: Synthetic peptide
  humAb-D vlCDR1
KASQNVDTNVA

SEQ ID NO: 151 - protein, 7 aa, Artificial Sequence
  Description of Artificial Sequence: Synthetic peptide
  humAb-D vlCDR2
SASYRYS

SEQ ID NO: 152 - protein, 9 aa, Artificial Sequence
  Description of Artificial Sequence: Synthetic peptide
  humAb-D vlCDR3
QQYNNYPFT

SEQ ID NO: 153 - protein, 124 aa, Artificial Sequence
  Description of Artificial Sequence: Synthetic polypeptide
  M30 Variable heavy (vh) domain
VHEVQLQQSGPELVKPGASVKMSCKASGYTFTNYVMHWVKQKPGQGLEWIGYINPYNDDVKYNEKFKGKATQTSDKSSSTAYMELSSLTSEDSAVYYCARWGYYGSPLYYFDYWGQGTTLTVSS

SEQ ID NO: 154 - protein, 5 aa, Artificial Sequence
  Description of Artificial Sequence: Synthetic peptide
  M30 vhCDR1
NYVMH

SEQ ID NO: 155 - protein, 17 aa, Artificial Sequence
  Description of Artificial Sequence: Synthetic peptide
  M30 vhCDR2
YINPYNDDVKYNEKFKG

SEQ ID NO: 156 - protein, 13 aa, Artificial Sequence
  Description of Artificial Sequence: Synthetic peptide
  M30 vhCDR3
WGYYGSPLYYFDY

SEQ ID NO: 157 - protein, 108 aa, Artificial Sequence
  Description of Artificial Sequence: Synthetic polypeptide
  M30 Variable light (vl) domain
VLQIVLSQSPTILSASPGEKVTMTCRASSRLIYMHWYQQKPGSSPKPWIYATSNLASGVPARFSGSGSGTSYSLTISRVEAEDAATYYCQQWNSNPPTFGTGTKLELK

SEQ ID NO: 158 - protein, 10 aa, Artificial Sequence
  Description of Artificial Sequence: Synthetic peptide
  M30 vlCDR1
RASSRLIYMH

SEQ ID NO: 159 - protein, 7 aa, Artificial Sequence
  Description of Artificial Sequence: Synthetic peptide
  M30 vlCDR2
ATSNLAS

SEQ ID NO: 160 - protein, 9 aa, Artificial Sequence
  Description of Artificial Sequence: Synthetic peptide
  M30 vlCDR3
QQWNSNPPT

SEQ ID NO: 161 - protein, 124 aa, Artificial Sequence
  Description of Artificial Sequence: Synthetic polypeptide
  M30-H1-L4 Variable heavy (vh) domain
VHQVQLVQSGAEVKKPGSSVKVSCKASGYTFTNYVMHWVRQAPGQGLEWMGYINPYNDDVKYNEKFKGRVTITADESTSTAYMELSSLRSEDTAVYYCARWGYYGSPLYYFDYWGQGTLVTVSS

SEQ ID NO: 162 - protein, 5 aa, Artificial Sequence
  Description of Artificial Sequence: Synthetic peptide
  M30-H1-L4 vhCDR1
NYVMH

SEQ ID NO: 163 - protein, 17 aa, Artificial Sequence
  Description of Artificial Sequence: Synthetic peptide
  M30-H1-L4 vhCDR2
YINPYNDDVKYNEKFKG

SEQ ID NO: 164 - protein, 13 aa, Artificial Sequence
  Description of Artificial Sequence: Synthetic peptide
  M30-H1-L4 vhCDR3
WGYYGSPLYYFDY

SEQ ID NO: 165 - protein, 108 aa, Artificial Sequence
  Description of Artificial Sequence: Synthetic polypeptide
  M30-H1-L4 Variable light (vl) domain
VLQIVLSQSPATLSLSPGERATLTCRASSRLIYMHWYQQKPGSAPKLWIYATSNLASGIPARFSGSGSGTSYTLTISRLEPEDFAVYYCQQWNSNPPTFGQGTKVEIK

SEQ ID NO: 166 - protein, 10 aa, Artificial Sequence
  Description of Artificial Sequence: Synthetic peptide
  M30-H1-L4 vlCDR1
RASSRLIYMH

SEQ ID NO: 167 - protein, 7 aa, Artificial Sequence
  Description of Artificial Sequence: Synthetic peptide
  M30-H1-L4 vlCDR2
ATSNLAS

SEQ ID NO: 168 - protein, 9 aa, Artificial Sequence
  Description of Artificial Sequence: Synthetic peptide
  M30-H1-L4 vlCDR3
QQWNSNPPT

SEQ ID NO: 169 - protein, 122 aa, Artificial Sequence
  Description of Artificial Sequence: Synthetic polypeptide
  SP265 Variable heavy (vh) domain
VHQSVEESRGGLIKPTDTLTLTCTVSGFSLGSYGVSWVRQAPGNGLEWIGGSGKRGNPYYASWAKSRSTITRNTNLNTVTLKMTSLTAADTATYFCASRAPVVSTSMTFNIWGPGTLVTVSS

SEQ ID NO: 170 - protein, 5 aa, Artificial Sequence
  Description of Artificial Sequence: Synthetic peptide
  SP265 vhCDR1
SYGVS

SEQ ID NO: 171 - protein, 16 aa, Artificial Sequence
  Description of Artificial Sequence: Synthetic peptide
  SP265 vhCDR2
GSGKRGNPYYASWAKS

SEQ ID NO: 172 - protein, 13 aa, Artificial Sequence
  Description of Artificial Sequence: Synthetic peptide
  SP265 vhCDR3
RAPVVSTSMTFNI

SEQ ID NO: 173 - protein, 115 aa, Artificial Sequence
  Description of Artificial Sequence: Synthetic polypeptide
  SP265 Variable light (vl) domain
VLAQVPTQTPSPVSAAVGGTVTINCQASQSVYNNKNLSWYQQKPGQPPKLLIYEASTLASGVPSRFSGSGSGTQFALTISGVQCEDAATYYCQGEFTCSGADCGAFGGGTEVVVK

SEQ ID NO: 174 - protein, 13 aa, Artificial Sequence
  Description of Artificial Sequence: Synthetic peptide
  SP265 vlCDR1
QASQSVYNNKNLS

SEQ ID NO: 175 - protein, 7 aa, Artificial Sequence
  Description of Artificial Sequence: Synthetic peptide
  SP265 vlCDR2
EASTLAS

SEQ ID NO: 176 - protein, 13 aa, Artificial Sequence
  Description of Artificial Sequence: Synthetic peptide
  SP265 vlCDR3
QGEFTCSGADCGA

SEQ ID NO: 177 - protein, 124 aa, Artificial Sequence
  Description of Artificial Sequence: Synthetic polypeptide
  S10-H50L58 Variable heavy (vh) domain
VHQEQLEESGGDLVKPGASLTLTCTASGFSFSSSYWICWVRQAPGKGLEWIACIYAGSSLNTYYAPWAKGRFTISKTSSATVTLQMTSLTAADTATYSCARTVVGGWGYALDLWGPGTLVTVSS

SEQ ID NO: 178 - protein, 6 aa, Artificial Sequence
  Description of Artificial Sequence: Synthetic peptide
  S10-H50L58 vhCDR1
SSYWIC

SEQ ID NO: 179 - protein, 18 aa, Artificial Sequence
  Description of Artificial Sequence: Synthetic peptide
  S10-H50L58 vhCDR2
CIYAGSSLNTYYAPWAKG

SEQ ID NO: 180 - protein, 12 aa, Artificial Sequence
  Description of Artificial Sequence: Synthetic peptide
  S10-H50L58 vhCDR3
TVVGGWGYALDL

SEQ ID NO: 181 - protein, 114 aa, Artificial Sequence
  Description of Artificial Sequence: Synthetic polypeptide
  S10-H50L58 Variable light (vl) domain
VLQVLTQTPSPVSAAVGGTVTINCQASQSVYNNKNLSWYQQKPGQPPKLLIYEASTLASGVPSRFSGSGSGTQFALTISGVQCEDAATYYCQGEFTCSGADCGAFGGGTEVVVK

SEQ ID NO: 182 - protein, 13 aa, Artificial Sequence
  Description of Artificial Sequence: Synthetic peptide
  S10-H50L58 vlCDR1
QASQSVYNNKNLS

SEQ ID NO: 183 - protein, 7 aa, Artificial Sequence
  Description of Artificial Sequence: Synthetic peptide
  S10-H50L58 vlCDR2
EASTLAS

SEQ ID NO: 184 - protein, 13 aa, Artificial Sequence
  Description of Artificial Sequence: Synthetic peptide
  S10-H50L58 vlCDR3
QGEFTCSGADCGA

SEQ ID NO: 185 - protein, 120 aa, Artificial Sequence
  Description of Artificial Sequence: Synthetic polypeptide
  8H9 Variable heavy (vh) domain
VHQVKLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTTVTVSS

SEQ ID NO: 186 - protein, 5 aa, Artificial Sequence
  Description of Artificial Sequence: Synthetic peptide
  8H9 vhCDR1
NYDIN

SEQ ID NO: 187 - protein, 17 aa, Artificial Sequence
  Description of Artificial Sequence: Synthetic peptide
  8H9 vhCDR2
WIFPGDGSTQYNEKFKG

SEQ ID NO: 188 - protein, 9 aa, Artificial Sequence
  Description of Artificial Sequence: Synthetic peptide
  8H9 vhCDR3
QTTATWFAY

SEQ ID NO: 189 - protein, 109 aa, Artificial Sequence
  Description of Artificial Sequence: Synthetic polypeptide
  8H9 Variable light (vl) domain
VLDIELTQSPTTLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 190 - protein, 11 aa, Artificial Sequence
  Description of Artificial Sequence: Synthetic peptide
  8H9 vlCDR1
RASQSISDYLH

SEQ ID NO: 191 - protein, 7 aa, Artificial Sequence
  Description of Artificial Sequence: Synthetic peptide
  8H9 vlCDR2
YASQSIS

SEQ ID NO: 192 - protein, 9 aa, Artificial Sequence
  Description of Artificial Sequence: Synthetic peptide
  8H9 vlCDR3
QNGHSFPLT

SEQ ID NO: 193 - protein, 122 aa, Artificial Sequence
  Description of Artificial Sequence: Synthetic polypeptide
  m852 Variable heavy (vh) domain
VHQVQLQQSGAEVKKPGSSVKVSCKASGGTFSSYAISWVRQAPGQGLEWMGGIIPILGIANYAQKFQGRVTITADESTSTAYMELSSLRSEDTAVYYCARGRRSGSYYMGYWGQGTLVTVSS

SEQ ID NO: 194 - protein, 5 aa, Artificial Sequence
  Description of Artificial Sequence: Synthetic peptide
  m852 vhCDR1
SYAIS

SEQ ID NO: 195 - protein, 17 aa, Artificial Sequence
  Description of Artificial Sequence: Synthetic peptide
  m852 vhCDR2
GIIPILGIANYAQKFQG

SEQ ID NO: 196 - protein, 11 aa, Artificial Sequence
  Description of Artificial Sequence: Synthetic peptide
  m852 vhCDR3
GRRSGSYYMGY

SEQ ID NO: 197 - protein, 111 aa, Artificial Sequence
  Description of Artificial Sequence: Synthetic polypeptide
  m852 Variable light (vl) domain
VLEIVLTQSPATLSLSPGERATLSCRASQSVSSNLAWYQQKPGQAPRLLIYDTSTRATGIPARFSGSGSGTEFTLTISSLQSEDFAVYYCQQYNNWPPAYTFGQGTKLEIK

SEQ ID NO: 198 - protein, 11 aa, Artificial Sequence
  Description of Artificial Sequence: Synthetic peptide
  m852 vlCDR1
RASQSVSSNLA

SEQ ID NO: 199 - protein, 7 aa, Artificial Sequence
  Description of Artificial Sequence: Synthetic peptide
  m852 vlCDR2
DTSTRAT

SEQ ID NO: 200 - protein, 11 aa, Artificial Sequence
  Description of Artificial Sequence: Synthetic peptide
  m852 vlCDR3
QQYNNWPPAYT

SEQ ID NO: 201 - protein, 121 aa, Artificial Sequence
  Description of Artificial Sequence: Synthetic polypeptide
  m857 Variable heavy (vh) domain
VHQVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGSYAFDIWGQGTMVTVSS

SEQ ID NO: 202 - protein, 5 aa, Artificial Sequence
  Description of Artificial Sequence: Synthetic peptide
  m857 vhCDR1
SYAIS

SEQ ID NO: 203 - protein, 17 aa, Artificial Sequence
  Description of Artificial Sequence: Synthetic peptide
  m857 vhCDR2
GIIPILGIANYAQKFQG

SEQ ID NO: 204 - protein, 10 aa, Artificial Sequence
  Description of Artificial Sequence: Synthetic peptide
  m857 vhCDR3
GGSGSYAFDI

SEQ ID NO: 205 - protein, 111 aa, Artificial Sequence
  Description of Artificial Sequence: Synthetic polypeptide
  m857 Variable light (vl) domain
VLEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIK

SEQ ID NO: 206 - protein, 11 aa, Artificial Sequence
  Description of Artificial Sequence: Synthetic peptide
  m857 vlCDR1
RASQSVSSYLA

SEQ ID NO: 207 - protein, 7 aa, Artificial Sequence
  Description of Artificial Sequence: Synthetic peptide
  m857 vlCDR2
DASNRAT

SEQ ID NO: 208 - protein, 11 aa, Artificial Sequence
  Description of Artificial Sequence: Synthetic peptide
  m857 vlCDR3
QQRSNWPPSYT

SEQ ID NO: 209 - protein, 121 aa, Artificial Sequence
  Description of Artificial Sequence: Synthetic polypeptide
  m8524 Variable heavy (vh) domain
VHQVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGSGSYHMDVWGKGTTVTVSS

SEQ ID NO: 210 - protein, 5 aa, Artificial Sequence
  Description of Artificial Sequence: Synthetic peptide
  m8524 vhCDR1
SYAIS

SEQ ID NO: 211 - protein, 17 aa, Artificial Sequence
  Description of Artificial Sequence: Synthetic peptide
  m8524 vhCDR2
GIIPILGIANYAQKFQG

SEQ ID NO: 212 - protein, 10 aa, Artificial Sequence
  Description of Artificial Sequence: Synthetic peptide
  m8524 vhCDR3
GGSGSYHMDV

SEQ ID NO: 213 - protein, 111 aa, Artificial Sequence
  Description of Artificial Sequence: Synthetic polypeptide
  m8524 Variable light (vl) domain
VLEIVLTQSPATLSLSPGERATLSCRASQSVSSYLAWYQQKPGQAPRLLIYDASNRATGIPARFSGSGSGTDFTLTISSLEPEDFAVYYCQQRSNWPPRITFGQGTRLEIK

SEQ ID NO: 214 - protein, 11 aa, Artificial Sequence
  Description of Artificial Sequence: Synthetic peptide
  m8524 vlCDR1
RASQSVSSYLA

SEQ ID NO: 215 - protein, 7 aa, Artificial Sequence
  Description of Artificial Sequence: Synthetic peptide
  m8524 vlCDR2
DASNRAT

SEQ ID NO: 216 - protein, 11 aa, Artificial Sequence
  Description of Artificial Sequence: Synthetic peptide
  m8524 vlCDR3
QQRSNWPPRIT

SEQ ID NO: 217 - protein, 120 aa, Artificial Sequence
  Description of Artificial Sequence: Synthetic polypeptide
  1_1 Variable heavy (vh) domain
VHQVQLQQSGAEVKKPGASVKVSCKASGYTFTNYDINWVRQAPGQGLEWIGWIFPGDGSTQYNGKFKGRATLTTDTSTSTAYMELSSLRSEDTAVYFCARQTTGTWFAYWGQGTLVTVSS

SEQ ID NO: 218 - protein, 5 aa, Artificial Sequence
  Description of Artificial Sequence: Synthetic peptide
  1_1 vhCDR1
NYDIN

SEQ ID NO: 219 - protein, 17 aa, Artificial Sequence
  Description of Artificial Sequence: Synthetic peptide
  1_1 vhCDR2
WIFPGDGSTQYNGKFKG

SEQ ID NO: 220 - protein, 9 aa, Artificial Sequence
  Description of Artificial Sequence: Synthetic peptide
  1_1 vhCDR3
QTTGTWFAY

SEQ ID NO: 221 - protein, 109 aa, Artificial Sequence
  Description of Artificial Sequence: Synthetic polypeptide
  1_1 Variable light (vl) domain
VLDIVLTQSPATLSLSPGERATLSCRASQSISPYLHWYQQKPGQAPRLLIKYASQSWSGIPARFSGSGSGSDFTLTISSLEPEDFAVYYCQNGHSFPLTFGGGTKVEIK

SEQ ID NO: 222 - protein, 11 aa, Artificial Sequence
  Description of Artificial Sequence: Synthetic peptide
  1_1 vlCDR1
RASQSISPYLH

SEQ ID NO: 223 - protein, 7 aa, Artificial Sequence
  Description of Artificial Sequence: Synthetic peptide
  1_1 vlCDR2
YASQSWS

SEQ ID NO: 224 - protein, 9 aa, Artificial Sequence
  Description of Artificial Sequence: Synthetic peptide
  1_1 vlCDR3
QNGHSFPLT

SEQ ID NO: 225 - protein, 120 aa, Artificial Sequence
  Description of Artificial Sequence: Synthetic polypeptide
  1_2 Variable heavy (vh) domain
VHQVQLQQSGAEVKKPGASVKVSCKASGYTFTNYDINWVRQAPGQGLEWIGWIFPGDGSTQYNETFKGRATLTTDTSTSTAYMELSSLRSEDTAVYFCARQTTGTWFAYWGQGTLVTVSS

SEQ ID NO: 226 - protein, 5 aa, Artificial Sequence
  Description of Artificial Sequence: Synthetic peptide
  1_2 vhCDR1
NYDIN

SEQ ID NO: 227 - protein, 17 aa, Artificial Sequence
  Description of Artificial Sequence: Synthetic peptide
  1_2 vhCDR2
WIFPGDGSTQYNETFKG

SEQ ID NO: 228 - protein, 9 aa, Artificial Sequence
  Description of Artificial Sequence: Synthetic peptide
  1_2 vhCDR3
QTTGTWFAY

SEQ ID NO: 229 - protein, 109 aa, Artificial Sequence
  Description of Artificial Sequence: Synthetic polypeptide
  1_2 Variable light (vl) domain
VLDIVLTQSPATLSLSPGERATLSCRASQSISKYLHWYQQKPGQAPRLLIKYANQSIRGIPARFSGSGSGSDFTLTISSLEPEDFAVYYCQNGHSFPLTFGGGTKVEIK

SEQ ID NO: 230 - protein, 11 aa, Artificial Sequence
  Description of Artificial Sequence: Synthetic peptide
  1_2 vlCDR1
RASQSISKYLH

SEQ ID NO: 231 - protein, 7 aa, Artificial Sequence
  Description of Artificial Sequence: Synthetic peptide
  1_2 vlCDR2
YANQSIR

SEQ ID NO: 232 - protein, 9 aa, Artificial Sequence
  Description of Artificial Sequence: Synthetic peptide
  1_2 vlCDR3
QNGHSFPLT

SEQ ID NO: 233 - protein, 120 aa, Artificial Sequence
  Description of Artificial Sequence: Synthetic polypeptide
  1_4 Variable heavy (vh) domain
VHQVQLQQSGAEVKKPGASVKVSCKASGYTFTNYDINWVRQAPGQGLEWIGWIFPGDGSTQYNPKFKGRATLTTDTSTSTAYMELSSLRSEDTAVYFCARQTTGTWFAYWGQGTLVTVSS

SEQ ID NO: 234 - protein, 5 aa, Artificial Sequence
  Description of Artificial Sequence: Synthetic peptide
  1_4 vhCDR1
NYDIN

SEQ ID NO: 235 - protein, 17 aa, Artificial Sequence
  Description of Artificial Sequence: Synthetic peptide
  1_4 vhCDR2
WIFPGDGSTQYNPKFKG

SEQ ID NO: 236 - protein, 9 aa, Artificial Sequence
  Description of Artificial Sequence: Synthetic peptide
  1_4 vhCDR3
QTTGTWFAY

SEQ ID NO: 237 - protein, 109 aa, Artificial Sequence
  Description of Artificial Sequence: Synthetic polypeptide
  1_4 Variable light (vl) domain
VLDIVLTQSPATLSLSPGERATLSCRASQSISTYLHWYQQKPGQAPRLLIKEASQSISGIPARFSGSGSGSDFTLTISSLEPEDFAVYYCQNGHSFPLTFGGGTKVEIK

SEQ ID NO: 238 - protein, 11 aa, Artificial Sequence
  Description of Artificial Sequence: Synthetic peptide
  1_4 vlCDR1
RASQSISTYLH

SEQ ID NO: 239 - protein, 7 aa, Artificial Sequence
  Description of Artificial Sequence: Synthetic peptide
  1_4 vlCDR2
EASQSIS

SEQ ID NO: 240 - protein, 9 aa, Artificial Sequence
  Description of Artificial Sequence: Synthetic peptide
  1_4 vlCDR3
QNGHSFPLT

SEQ ID NO: 241 - protein, 120 aa, Artificial Sequence
  Description of Artificial Sequence: Synthetic polypeptide
  1_5 Variable heavy (vh) domain
VHQVQLQQSGAEVKKPGASVKVSCKASGYTFTNYDINWVRQAPGQGLEWIGWIFPGDGSTQYNEKFKGRATLTTDTSTSTAYMELSSLRSEDTAVYFCARQTTGTWFAYWGQGTLVTVSS

SEQ ID NO: 242 - protein, 5 aa, Artificial Sequence
  Description of Artificial Sequence: Synthetic peptide
  1_5 vhCDR1
NYDIN

SEQ ID NO: 243 - protein, 17 aa, Artificial Sequence
  Description of Artificial Sequence: Synthetic peptide
  1_5 vhCDR2
WIFPGDGSTQYNEKFKG

SEQ ID NO: 244 - protein, 9 aa, Artificial Sequence
  Description of Artificial Sequence: Synthetic peptide
  1_5 vhCDR3
QTTGTWFAY

SEQ ID NO: 245 - protein, 109 aa, Artificial Sequence
  Description of Artificial Sequence: Synthetic polypeptide
  1_5 Variable light (vl) domain
VLDIVLTQSPATLSLSPGERATLSCRASQSISHYLHWYQQKPGQAPRLLIKYASQSLSGIPARFSGSGSGSDFTLTISSLEPEDFAVYYCQNGHSFPLTFGGGTKVEIK

SEQ ID NO: 246 - protein, 11 aa, Artificial Sequence
  Description of Artificial Sequence: Synthetic peptide
  1_5 vlCDR1
RASQSISHYLH

SEQ ID NO: 247 - protein, 7 aa, Artificial Sequence
  Description of Artificial Sequence: Synthetic peptide
  1_5 vlCDR2
YASQSLS

SEQ ID NO: 248 - protein, 9 aa, Artificial Sequence
  Description of Artificial Sequence: Synthetic peptide
  1_5 vlCDR3
QNGHSFPLT

SEQ ID NO: 249 - protein, 120 aa, Artificial Sequence
  Description of Artificial Sequence: Synthetic polypeptide
  1_7 Variable heavy (vh) domain
VHQVQLQQSGAEVKKPGASVKVSCKASGYTYTNYDINWVRQAPGQGLEWIGWIFPGDGSTQYNEKFKGRATLTTDTSTSTAYMELSSLRSEDTAVYFCARQTTGTWFAYWGQGTLVTVSS

SEQ ID NO: 250 - protein, 5 aa, Artificial Sequence
  Description of Artificial Sequence: Synthetic peptide
  1_7 vhCDR1
NYDIN

SEQ ID NO: 251 - protein, 17 aa, Artificial Sequence
  Description of Artificial Sequence: Synthetic peptide
  1_7 vhCDR2
WIFPGDGSTQYNEKFKG

SEQ ID NO: 252 - protein, 9 aa, Artificial Sequence
  Description of Artificial Sequence: Synthetic peptide
  1_7 vhCDR3
QTTGTWFAY

SEQ ID NO: 253 - protein, 109 aa, Artificial Sequence
  Description of Artificial Sequence: Synthetic polypeptide
  1_7 Variable light (vl) domain
VLDIVLTQSPATLSLSPGERATLSCRASQSISPYLHWYQQKPGQAPRLLIKHASQSISGIPARFSGSGSGSDFTLTISSLEPEDFAVYYCQNGHSFPLTFGGGTKVEIK

SEQ ID NO: 254 - protein, 11 aa, Artificial Sequence
  Description of Artificial Sequence: Synthetic peptide
  1_7 vlCDR1
RASQSISPYLH

SEQ ID NO: 255 - protein, 7 aa, Artificial Sequence
  Description of Artificial Sequence: Synthetic peptide
  1_7 vlCDR2
HASQSIS

SEQ ID NO: 256 - protein, 9 aa, Artificial Sequence
  Description of Artificial Sequence: Synthetic peptide
  1_7 vlCDR3
QNGHSFPLT

SEQ ID NO: 257 - protein, 120 aa, Artificial Sequence
  Description of Artificial Sequence: Synthetic polypeptide
  2_5 Variable heavy (vh) domain
VHQVQLQQSGAEVKKPGASVKVSCKASGYTFTNYDINWVRQAPGQGLEWIGWIFPGDGSTQYNEKFKGRATLTTDTSTSTAYMELSSLRSEDTAVYFCARQTTSTWFAYWGQGTLVTVSS

SEQ ID NO: 258 - protein, 5 aa, Artificial Sequence
  Description of Artificial Sequence: Synthetic peptide
  2_5 vhCDR1
NYDIN

SEQ ID NO: 259 - protein, 17 aa, Artificial Sequence
  Description of Artificial Sequence: Synthetic peptide
  2_5 vhCDR2
WIFPGDGSTQYNEKFKG

SEQ ID NO: 260 - protein, 9 aa, Artificial Sequence
  Description of Artificial Sequence: Synthetic peptide
  2_5 vhCDR3
QTTSTWFAY

SEQ ID NO: 261 - protein, 109 aa, Artificial Sequence
  Description of Artificial Sequence: Synthetic polypeptide
  2_5 Variable light (vl) domain
VLDIVLTQSPATLSLSPGERATLSCRASQIISDYLHWYQQKPGQAPRLLIKYASQLISGIPARFSGSGSGSDFTLTISSLEPEDFAVYYCQNGHSFPLTFGGGTKVEIK

SEQ ID NO: 262 - protein, 11 aa, Artificial Sequence
  Description of Artificial Sequence: Synthetic peptide
  2_5 vlCDR1
RASQIISDYLH

SEQ ID NO: 263 - protein, 7 aa, Artificial Sequence
  Description of Artificial Sequence: Synthetic peptide
  2_5 vlCDR2
YASQLIS

SEQ ID NO: 264 - protein, 9 aa, Artificial Sequence
  Description of Artificial Sequence: Synthetic peptide
  2_5 vlCDR3
QNGHSFPLT

SEQ ID NO: 265 - protein, 120 aa, Artificial Sequence; identical to SEQ ID NO: 241
  Description of Artificial Sequence: Synthetic polypeptide
  2_8 Variable heavy (vh) domain

SEQ ID NO: 266 - protein, 5 aa, Artificial Sequence
  Description of Artificial Sequence: Synthetic peptide
  2_8 vhCDR1
NYDIN

SEQ ID NO: 267 - protein, 17 aa, Artificial Sequence
  Description of Artificial Sequence: Synthetic peptide
  2_8 vhCDR2
WIFPGDGSTQYNEKFKG

SEQ ID NO: 268 - protein, 9 aa, Artificial Sequence
  Description of Artificial Sequence: Synthetic peptide
  2_8 vhCDR3
QTTGTWFAY

SEQ ID NO: 269 - protein, 109 aa, Artificial Sequence
  Description of Artificial Sequence: Synthetic polypeptide
  2_8 Variable light (vl) domain
VLDIVLTQSPATLSLSPGERATLSCRASQSISEYLHWYQQKPGQAPRLLIKHASQSISGIPARFSGSGSGSDFTLTISSLEPEDFAVYYCQNGHSFPLTFGGGTKVEIK

SEQ ID NO: 270 - protein, 11 aa, Artificial Sequence
  Description of Artificial Sequence: Synthetic peptide
  2_8 vlCDR1
RASQSISEYLH

SEQ ID NO: 271 - protein, 7 aa, Artificial Sequence
  Description of Artificial Sequence: Synthetic peptide
  2_8 vlCDR2
HASQSIS

SEQ ID NO: 272 - protein, 9 aa, Artificial Sequence
  Description of Artificial Sequence: Synthetic peptide
  2_8 vlCDR3
QNGHSFPLT

SEQ ID NO: 273 - protein, 122 aa, Artificial Sequence
  Description of Artificial Sequence: Synthetic polypeptide
  chAb2 Variable heavy (vh) domain
VHQVQLQQPGAELVKPGASVKLSCKASGYTFTSYWMHWVKQRPGQGLEWIGMIHPDSGTTNYNEKFRSKATLTVDKSSSTAYMQLSSLTSEDSAVYYCAVYYGSTYWYFDVWGTGTTVTVSS

SEQ ID NO: 274 - protein, 5 aa, Artificial Sequence
  Description of Artificial Sequence: Synthetic peptide
  chAb2 vhCDR1
SYWMH

SEQ ID NO: 275 - protein, 17 aa, Artificial Sequence
  Description of Artificial Sequence: Synthetic peptide
  chAb2 vhCDR2
MIHPDSGTTNYNEKFRS

SEQ ID NO: 276 - protein, 11 aa, Artificial Sequence
  Description of Artificial Sequence: Synthetic peptide
  chAb2 vhCDR3
YYGSTYWYFDV

SEQ ID NO: 277 - protein, 114 aa, Artificial Sequence
  Description of Artificial Sequence: Synthetic polypeptide
  chAb2 Variable light (vl) domain
VLDVVMTQTPLSLPVSLGDQAYISCRSSQSLVHINGNTYLHWYRQKPGQSPKLLIYKVSNRFSGVPDRFSGSGSGTDFTLKISRVEAEDLGVYFCSQSTHFPFTFGSGTKLEIK

SEQ ID NO: 278 - protein, 16 aa, Artificial Sequence
  Description of Artificial Sequence: Synthetic peptide
  chAb2 vlCDR1
RSSQSLVHINGNTYLH

SEQ ID NO: 279 - protein, 7 aa, Artificial Sequence
  Description of Artificial Sequence: Synthetic peptide
  chAb2 vlCDR2
KVSNRFS

SEQ ID NO: 280 - protein, 9 aa, Artificial Sequence
  Description of Artificial Sequence: Synthetic peptide
  chAb2 vlCDR3
SQSTHFPFT

SEQ ID NO: 281 - protein, 119 aa, Artificial Sequence
  Description of Artificial Sequence: Synthetic polypeptide
  chAb3 Variable heavy (vh) domain
VHQVQLQQPGAELVKPGASVKLSCKASGYTFSSYWMHWVKQRPGQGLEWIGLIHPDSGSTNYNEMFKNKATLTVDRSSSTAYVQLSSLTSEDSAVYFCAGGGRLYFDYWGQGTTLTVSS

SEQ ID NO: 282 - protein, 5 aa, Artificial Sequence
  Description of Artificial Sequence: Synthetic peptide
  chAb3 vhCDR1
SYWMH

SEQ ID NO: 283 - protein, 17 aa, Artificial Sequence
  Description of Artificial Sequence: Synthetic peptide
  chAb3 vhCDR2
LIHPDSGSTNYNEMFKN

SEQ ID NO: 284 - protein, 8 aa, Artificial Sequence
  Description of Artificial Sequence: Synthetic peptide
  chAb3 vhCDR3
GGRLYFDY

SEQ ID NO: 285 - protein, 114 aa, Artificial Sequence
  Description of Artificial Sequence: Synthetic polypeptide
  chAb3 Variable light (vl) domain
VLDVVMTQTPLSLPVSLGDQASISCRSSQSLVHSNGDTYLRWYLQKPGQSPKLLIYKVSNRFSGVPDRFSGSGSGTDFTLKITRVEAEDLGVYFCSQSTHVPYTFGGGTKLEIK

SEQ ID NO: 286 - protein, 16 aa, Artificial Sequence
  Description of Artificial Sequence: Synthetic peptide
  chAb3 vlCDR1
RSSQSLVHSNGDTYLR

SEQ ID NO: 287 - protein, 7 aa, Artificial Sequence
  Description of Artificial Sequence: Synthetic peptide
  chAb3 vlCDR2
KVSNRFS

SEQ ID NO: 288 - protein, 9 aa, Artificial Sequence
  Description of Artificial Sequence: Synthetic peptide
  chAb3 vlCDR3
SQSTHVPYT

SEQ ID NO: 289 - protein, 119 aa, Artificial Sequence
  Description of Artificial Sequence: Synthetic polypeptide
  chAb4 Variable heavy (vh) domain
VHQVQLQQPGAELVKPGASVKLSCKASGYSFTSYWMHWVKQRPGQGLEWIGMIHPNSGSNNYNEKFKSKATLTVDKSSNTAYMQLSSLTSEDSAVYYCARRLGLHFDYWGQGTTLTVSS

SEQ ID NO: 290 - protein, 5 aa, Artificial Sequence
  Description of Artificial Sequence: Synthetic peptide
  chAb4 vhCDR1
SYWMH

SEQ ID NO: 291 - protein, 17 aa, Artificial Sequence
  Description of Artificial Sequence: Synthetic peptide
  chAb4 vhCDR2
MIHPNSGSNNYNEKFKS

SEQ ID NO: 292 - protein, 8 aa, Artificial Sequence
  Description of Artificial Sequence: Synthetic peptide
  chAb4 vhCDR3
RLGLHFDY

SEQ ID NO: 293 - protein, 107 aa, Artificial Sequence
  Description of Artificial Sequence: Synthetic polypeptide
  chAb4 Variable light (vl) domain
DIVMTQSQKFMSTPVGDRVSITCKASQNVGTAVAWYQQKPGQSPKLLIYSASNRYTGVPDRFTGSGSGTDFTLTISNMQSEDLADYFCQQYSSYPYTFGGGTKLEIK

SEQ ID NO: 294 - protein, 11 aa, Artificial Sequence
  Description of Artificial Sequence: Synthetic peptide
  chAb4 vlCDR1
KASQNVGTAVA

SEQ ID NO: 295 - protein, 7 aa, Artificial Sequence
  Description of Artificial Sequence: Synthetic peptide
  chAb4 vlCDR2
SASNRYT

SEQ ID NO: 296 - protein, 9 aa, Artificial Sequence
  Description of Artificial Sequence: Synthetic peptide
  chAb4 vlCDR3
QQYSSYPYT

SEQ ID NO: 297 - protein, 121 aa, Artificial Sequence
  Description of Artificial Sequence: Synthetic polypeptide
  chAb18 Variable heavy (vh) domain
QVQLQQSAAELARPGASVKMSCKASGYSFTSYTIHWVKQRPGQGLEWIGYINPNSRNTDYNQKFKDETTLTADRSSSTAYMQLISLTSEDSAVYYCARYSGSTPYWYFDVWGAGTTVTVSS

SEQ ID NO: 298 - protein, 5 aa, Artificial Sequence
  Description of Artificial Sequence: Synthetic peptide
  chAb18 vhCDR1
SYTIH

SEQ ID NO: 299 - protein, 17 aa, Artificial Sequence
  Description of Artificial Sequence: Synthetic peptide
  chAb18 vhCDR2
YINPNSRNTDYNQKFKD

SEQ ID NO: 300 - protein, 12 aa, Artificial Sequence
  Description of Artificial Sequence: Synthetic peptide
  chAb18 vhCDR3
YSGSTPYWYFDV

SEQ ID NO: 301 - protein, 106 aa, Artificial Sequence
  Description of Artificial Sequence: Synthetic polypeptide
  chAb18 Variable light (vl) domain
QIVLTQSPAILSASPGEKVTMTCRASSSVSYMNWYQQKPGSSPKPWIYATSNLASGVPARFSVSVSGTSHSLTISRVEAEDAATYYCQQWSSNPLTFGAGTKLELK

SEQ ID NO: 302 - protein, 10 aa, Artificial Sequence
  Description of Artificial Sequence: Synthetic peptide
  chAb18 vlCDR1
RASSSVSYMN

SEQ ID NO: 303 - protein, 7 aa, Artificial Sequence
  Description of Artificial Sequence: Synthetic peptide
  chAb18 vlCDR2
ATSNLAS

SEQ ID NO: 304 - protein, 9 aa, Artificial Sequence
  Description of Artificial Sequence: Synthetic peptide
  chAb18 vlCDR3
QQWSSNPLT

SEQ ID NO: 305 - protein, 116 aa, Artificial Sequence
  Description of Artificial Sequence: Synthetic polypeptide
  chAb13 Variable heavy (vh) domain
DVQLQESGPDLVKPSQSLSLTCTVTGYSITSGYSWHWIRQFPGNKLEWMGYIHSSGSTNYNPSLKSRISINRDTSKNQFFLQLNSVTTEDTATYYCAGYDDYFEYWGQGTTLTVSS

SEQ ID NO: 306 - protein, 6 aa, Artificial Sequence
  Description of Artificial Sequence: Synthetic peptide
  chAb13 vhCDR1
SGYSWH

SEQ ID NO: 307 - protein, 16 aa, Artificial Sequence
  Description of Artificial Sequence: Synthetic peptide
  chAb13 vhCDR2
YIHSSGSTNYNPSLKS

SEQ ID NO: 308 - protein, 7 aa, Artificial Sequence
  Description of Artificial Sequence: Synthetic peptide
  chAb13 vhCDR3
YDDYFEY

SEQ ID NO: 309 - protein, 107 aa, Artificial Sequence
  Description of Artificial Sequence: Synthetic polypeptide
  chAb13 Variable light (vl) domain
DIVMTQSQKFMSTSVGDRVSVTCKASQNVGFNVAWYQQKPGQSPKALIYSASYRYSGVPDRFTGSGSGTDFTLTISNVQSEDLAEYFCQQYNSYPFTFGSGTKLEIK

SEQ ID NO: 310 - protein, 11 aa, Artificial Sequence
  Description of Artificial Sequence: Synthetic peptide
  chAb13 vlCDR1
KASQNVGFNVA

SEQ ID NO: 311 - protein, 7 aa, Artificial Sequence
  Description of Artificial Sequence: Synthetic peptide
  chAb13 vlCDR2
SASYRYS

SEQ ID NO: 312 - protein, 9 aa, Artificial Sequence
  Description of Artificial Sequence: Synthetic peptide
  chAb13 vlCDR3
QQYNSYPFT

SEQ ID NO: 313 - protein, 118 aa, Artificial Sequence
  Description of Artificial Sequence: Synthetic polypeptide
  chAb12 Variable heavy (vh) domain
EVQLVESGGGLVKPGGSLKLSCAASGFTFSSYAMSWVRQTPEKRLEWVATISSGTNYTYYPDSVKGRFTISRDNAKNTLYLQMTSLRSEDTAMYYCARQGRYSWIAYWGQGTLVTVSA

SEQ ID NO: 314 - protein, 5 aa, Artificial Sequence
  Description of Artificial Sequence: Synthetic peptide
  chAb12 vhCDR1
SYAMS

SEQ ID NO: 315 - protein, 17 aa, Artificial Sequence
  Description of Artificial Sequence: Synthetic peptide
  chAb12 vhCDR2
TISSGTNYTYYPDSVKG

SEQ ID NO: 316 - protein, 9 aa, Artificial Sequence
  Description of Artificial Sequence: Synthetic peptide
  chAb12 vhCDR3
QGRYSWIAY

SEQ ID NO: 317 - protein, 110 aa, Artificial Sequence
  Description of Artificial Sequence: Synthetic polypeptide
  chAb12 Variable light (vl) domain
DIVLTQSPASLAVSLGQRATISCRASKSVSTSDYSYMHWNQQKPGQPPKLLIYLASNLESGVPARFSGSGSGTDFTLNIHPVEEEDAATYYCQHSRELLTFGAGTKLELK

SEQ ID NO: 318 - protein, 15 aa, Artificial Sequence
  Description of Artificial Sequence: Synthetic peptide
  chAb12 vlCDR1
RASKSVSTSDYSYMH

SEQ ID NO: 319 - protein, 7 aa, Artificial Sequence
  Description of Artificial Sequence: Synthetic peptide
  chAb12 vlCDR2
LASNLES

SEQ ID NO: 320 - protein, 8 aa, Artificial Sequence
  Description of Artificial Sequence: Synthetic peptide
  chAb12 vlCDR3
QHSRELLT

SEQ ID NO: 321 - protein, 118 aa, Artificial Sequence
  Description of Artificial Sequence: Synthetic polypeptide
  chAb14 Variable heavy (vh) domain
EVKLVESGGGLVKPGGSLKLSCAASGFTFSSYGMSWVRQTPEKRLEWVATISGGGTNTYYPDSVEGRFTISRDNAKNFLYLQMSSLRSEDTALYYCARHYGSQTMDYWGQGTSVTVSS

SEQ ID NO: 322 - protein, 5 aa, Artificial Sequence
  Description of Artificial Sequence: Synthetic peptide
  chAb14 vhCDR1
SYGMS

SEQ ID NO: 323 - protein, 17 aa, Artificial Sequence
  Description of Artificial Sequence: Synthetic peptide
  chAb14 vhCDR2
TISGGGTNTYYPDSVEG

SEQ ID NO: 324 - protein, 9 aa, Artificial Sequence
  Description of Artificial Sequence: Synthetic peptide
  chAb14 vhCDR3
HYGSQTMDY

SEQ ID NO: 325 - protein, 107 aa, Artificial Sequence
  Description of Artificial Sequence: Synthetic polypeptide
  chAb14 Variable light (vl) domain
DIQMTQSPASLSASVGETVTITCRTSGNIHNYLTWYQQKQGKSPQLLVYNAKTLADGVPSRFSGSGSGTQFSLKINSLQPEDFGSYYCQHFWSIMWTFGGGTKLEIK

SEQ ID NO: 326 - protein, 11 aa, Artificial Sequence
  Description of Artificial Sequence: Synthetic peptide
  chAb14 vlCDR1
RTSGNIHNYLT

SEQ ID NO: 327 - protein, 7 aa, Artificial Sequence
  Description of Artificial Sequence: Synthetic peptide
  chAb14 vlCDR2
NAKTLAD

SEQ ID NO: 328 - protein, 9 aa, Artificial Sequence
  Description of Artificial Sequence: Synthetic peptide
  chAb14 vlCDR3
QHFWSIMWT

SEQ ID NO: 329 - protein, 121 aa, Artificial Sequence
  Description of Artificial Sequence: Synthetic polypeptide
  chAb6 Variable heavy (vh) domain
QVQLQQSGAELMKPGASVKISCKATGYTFSRYWIEWVKQRPGHGLEWIGEILPGSGSTNYNEKFKGKATFTADTSSNTAYMQVSSLTSEDSAVHYCARRGYGYVPYALDYWGQGTSVTVSS

SEQ ID NO: 330 - protein, 5 aa, Artificial Sequence
  Description of Artificial Sequence: Synthetic peptide
  chAb6 vhCDR1
RYWIE

SEQ ID NO: 331 - protein, 17 aa, Artificial Sequence
  Description of Artificial Sequence: Synthetic peptide
  chAb6 vhCDR2
EILPGSGSTNYNEKFKG

SEQ ID NO: 332 - protein, 12 aa, Artificial Sequence
  Description of Artificial Sequence: Synthetic peptide
  chAb6 vhCDR3
RGYGYVPYALDY

SEQ ID NO: 333 - protein, 107 aa, Artificial Sequence
  Description of Artificial Sequence: Synthetic polypeptide
  chAb6 Variable light (vl) domain
EIQMTQTTSSLSASLGDRVTISCRASQDISNSLNWYQQKPDGTVNLLIYYTSRLYSGVPSRFSGSGSGTDYSLTISNLEQEDIATYFCQQGNTLPYTFGGGTKLEIK

SEQ ID NO: 334 - protein, 11 aa, Artificial Sequence
  Description of Artificial Sequence: Synthetic peptide
  chAb6 vlCDR1
RASQDISNSLN

SEQ ID NO: 335 - protein, 7 aa, Artificial Sequence
  Description of Artificial Sequence: Synthetic peptide
  chAb6 vlCDR2
YTSRLYS

SEQ ID NO: 336 - protein, 9 aa, Artificial Sequence
  Description of Artificial Sequence: Synthetic peptide
  chAb6 vlCDR3
QQGNTLPYT

SEQ ID NO: 337 - protein, 120 aa, Artificial Sequence
  Description of Artificial Sequence: Synthetic polypeptide
  chAb11 Variable heavy (vh) domain
EVKLVESGGGLVQPGGSLRLSCATSGFTFTNYYMSWVRQPPGKALEWLGFIRNKANDYTTEYSASVKGRFTISRDNSQSILYLQMNTLRAEDSATYYCARESPGNPFAYWGQGTLVTVSA

SEQ ID NO: 338 - protein, 5 aa, Artificial Sequence
  Description of Artificial Sequence: Synthetic peptide
  chAb11 vhCDR1
NYYMS

SEQ ID NO: 339 - protein, 19 aa, Artificial Sequence
  Description of Artificial Sequence: Synthetic peptide
  chAb11 vhCDR2
FIRNKANDYTTEYSASVKG

SEQ ID NO: 340 - protein, 9 aa, Artificial Sequence
  Description of Artificial Sequence: Synthetic peptide
  chAb11 vhCDR3
ESPGNPFAY

SEQ ID NO: 341 - protein, 113 aa, Artificial Sequence
  Description of Artificial Sequence: Synthetic polypeptide
  chAb11 Variable light (vl) domain
DIVMTQSPSSLTVTAGEKVTMTCKSSQSLLNSGTQKNFLTWYQQKPGQPPKLLIYWASTRESGVPDRFTGSGSGTDFTLTISSVQAEDLAVYFCQNDYIYPLTFGAGTKLELK

SEQ ID NO: 342 - protein, 17 aa, Artificial Sequence
  Description of Artificial Sequence: Synthetic peptide
  chAb11 vlCDR1
KSSQSLLNSGTQKNFLT

SEQ ID NO: 343 - protein, 7 aa, Artificial Sequence
  Description of Artificial Sequence: Synthetic peptide
  chAb11 vlCDR2
WASTRES

SEQ ID NO: 344 - protein, 9 aa, Artificial Sequence
  Description of Artificial Sequence: Synthetic peptide
  chAb11 vlCDR3
QNDYIYPLT

SEQ ID NO: 345 - protein, 121 aa, Artificial Sequence
  Description of Artificial Sequence: Synthetic polypeptide
  chAb16 Variable heavy (vh) domain
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGFGNYIYAMDYWGQGTSVTVSS

SEQ ID NO: 346 - protein, 5 aa, Artificial Sequence
  Description of Artificial Sequence: Synthetic peptide
  chAb16 vhCDR1
RYWMS

SEQ ID NO: 347 - protein, 17 aa, Artificial Sequence
  Description of Artificial Sequence: Synthetic peptide
  chAb16 vhCDR2
EINPDSSTINYTPSLKD

SEQ ID NO: 348 - protein, 12 aa, Artificial Sequence
  Description of Artificial Sequence: Synthetic peptide
  chAb16 vhCDR3
PGFGNYIYAMDY

SEQ ID NO: 349 - protein, 107 aa, Artificial Sequence
  Description of Artificial Sequence: Synthetic polypeptide
  chAb16 Variable light (vl) domain
DIQMTQTTSSLSASLGDRVTINCRASQDISNFLNWYQQKPDGTVKLLIYYTSRLYLGVPSRFSGSGSGTDYSLTISNLEQEDIATYFCQQGNTLPPTFGGGTKLEIK

SEQ ID NO: 350 - protein, 11 aa, Artificial Sequence
  Description of Artificial Sequence: Synthetic peptide
  chAb16 vlCDR1
RASQDISNFLN

SEQ ID NO: 351 - protein, 7 aa, Artificial Sequence
  Description of Artificial Sequence: Synthetic peptide
  chAb16 vlCDR2
YTSRLYL

SEQ ID NO: 352 - protein, 9 aa, Artificial Sequence
  Description of Artificial Sequence: Synthetic peptide
  chAb16 vlCDR3
QQGNTLPPT

SEQ ID NO: 353 - protein, 125 aa, Artificial Sequence
  Description of Artificial Sequence: Synthetic polypeptide
  chAb10 Variable heavy (vh) domain
DVQLQESGPGLVKPSQSLSLTCTVTGYSITSDYAWNWIRQFPGNRLEWMGHINYSGITNYNPSLKSRISITRDTSKNQFFLQLYSVTTEDTATYFCARRSLFYYYGSSLYAMDYWGQGTSVTVSS

SEQ ID NO: 354 - protein, 6 aa, Artificial Sequence
  Description of Artificial Sequence: Synthetic peptide
  chAb10 vhCDR1
SDYAWN

SEQ ID NO: 355 - protein, 16 aa, Artificial Sequence
  Description of Artificial Sequence: Synthetic peptide
  chAb10 vhCDR2
HINYSGITNYNPSLKS

SEQ ID NO: 356 - protein, 16 aa, Artificial Sequence
  Description of Artificial Sequence: Synthetic peptide
  chAb10 vhCDR3
RSLFYYYGSSLYAMDY

SEQ ID NO: 357 - protein, 112 aa, Artificial Sequence
  Description of Artificial Sequence: Synthetic polypeptide
  chAb10 Variable light (vl) domain
DVVMTQSPFSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 358 - protein, 16 aa, Artificial Sequence
  Description of Artificial Sequence: Synthetic peptide
  chAb10 vlCDR1
RSSQSLVHSNGNTYLH

SEQ ID NO: 359 - protein, 7 aa, Artificial Sequence
  Description of Artificial Sequence: Synthetic peptide
  chAb10 vlCDR2
KVSNRFS

SEQ ID NO: 360 - protein, 9 aa, Artificial Sequence
  Description of Artificial Sequence: Synthetic peptide
  chAb10 vlCDR3
SQSTHVPWT

SEQ ID NO: 361 - protein, 119 aa, Artificial Sequence
  Description of Artificial Sequence: Synthetic polypeptide
  chAb7 Variable heavy (vh) domain
EVQLVESGENLVKPGGSLKLSCAASGFSFRGYGMSWVRQTPDKRLEWVAAISTGGNYTYYPDSVQGRFTISRDNANNTLYLQMSSLKSEDTAMYYCARRGGNYAGFAYWGQGTLVTVSA

SEQ ID NO: 362 - protein, 5 aa, Artificial Sequence
  Description of Artificial Sequence: Synthetic peptide
  chAb7 vhCDR1
GYGMS

SEQ ID NO: 363 - protein, 17 aa, Artificial Sequence
  Description of Artificial Sequence: Synthetic peptide
  chAb7 vhCDR2
AISTGGNYTYYPDSVQG

SEQ ID NO: 364 - protein, 10 aa, Artificial Sequence
  Description of Artificial Sequence: Synthetic peptide
  chAb7 vhCDR3
RGGNYAGFAY

SEQ ID NO: 365 - protein, 107 aa, Artificial Sequence
  Description of Artificial Sequence: Synthetic polypeptide
  chAb7 Variable light (vl) domain
DIQMTQSPASLSVSVGETVTITCRPSENIYSNLAWYQQKQGKSPQLLVYAATNLADGVPSRFSGSGSGTQYSLKINSLQSEDFGTYYCQHFWGTPFTFGSGTKLEIK

SEQ ID NO: 366 - protein, 11 aa, Artificial Sequence
  Description of Artificial Sequence: Synthetic peptide
  chAb7 vlCDR1
RPSENIYSNLA

SEQ ID NO: 367 - protein, 7 aa, Artificial Sequence
  Description of Artificial Sequence: Synthetic peptide
  chAb7 vlCDR2
AATNLAD

SEQ ID NO: 368 - protein, 9 aa, Artificial Sequence
  Description of Artificial Sequence: Synthetic peptide
  chAb7 vlCDR3
QHFWGTPFT

SEQ ID NO: 369 - protein, 121 aa, Artificial Sequence
  Description of Artificial Sequence: Synthetic polypeptide
  chAb8 Variable heavy (vh) domain
EVKLVESGGGLVKPGGSLKLSCAASGFTFSSYGMSWVRQTPEKRLEWVATISGGGNYTYCPDSVKGRFTISRDNAKNNLYLQMSSLRSEDTALYYCTRQRGYDYHYAMDFWGQGTSVTVSS

SEQ ID NO: 370 - protein, 5 aa, Artificial Sequence
  Description of Artificial Sequence: Synthetic peptide
  chAb8 vhCDR1
SYGMS

SEQ ID NO: 371 - protein, 17 aa, Artificial Sequence
  Description of Artificial Sequence: Synthetic peptide
  chAb8 vhCDR2
TISGGGNYTYCPDSVKG

SEQ ID NO: 372 - protein, 12 aa, Artificial Sequence
  Description of Artificial Sequence: Synthetic peptide
  chAb8 vhCDR3
QRGYDYHYAMDF

SEQ ID NO: 373 - protein, 107 aa, Artificial Sequence
  Description of Artificial Sequence: Synthetic polypeptide
  chAb8 Variable light (vl) domain
DIQMTQSPASLSVSVGETVTITCRASENIYSNLAWHQQKQGKSPQLLVYAATNLADGVPSRFSGNGSDTQYSLKINSLQSEDFGSYFCQNFWGTSWTFGGGTKLEIK

SEQ ID NO: 374 - protein, 11 aa, Artificial Sequence
  Description of Artificial Sequence: Synthetic peptide
  chAb8 vlCDR1
RASENIYSNLA

SEQ ID NO: 375 - protein, 7 aa, Artificial Sequence
  Description of Artificial Sequence: Synthetic peptide
  chAb8 vlCDR2
AATNLAD

SEQ ID NO: 376 - protein, 9 aa, Artificial Sequence
  Description of Artificial Sequence: Synthetic peptide
  chAb8 vlCDR3
QNFWGTSWT

SEQ ID NO: 377 - protein, 117 aa, Artificial Sequence
  Description of Artificial Sequence: Synthetic polypeptide
  chAb17 Variable heavy (vh) domain
EVKLVESGGGLVQPGGSLKLSCAASGFTFSSYIMSWVRQTPEKRLEWVASIVSSNITYYPDSMKGRFTISRDNARNILYLQMSSLKSEDTAMYYCARSGTRAWFAYWGQGTLVTVSA

SEQ ID NO: 378 - protein, 5 aa, Artificial Sequence
  Description of Artificial Sequence: Synthetic peptide
  chAb17 vhCDR1
SYIMS

SEQ ID NO: 379 - protein, 16 aa, Artificial Sequence
  Description of Artificial Sequence: Synthetic peptide
  chAb17 vhCDR2
SIVSSNITYYPDSMKG

SEQ ID NO: 380 - protein, 9 aa, Artificial Sequence
  Description of Artificial Sequence: Synthetic peptide
  chAb17 vhCDR3
SGTRAWFAY

SEQ ID NO: 381 - protein, 111 aa, Artificial Sequence
  Description of Artificial Sequence: Synthetic polypeptide
  chAb17 Variable light (vl) domain
DIVLTQSPASLAVSLGQRATISCRASKSVSTSAYSYMHWYQQKPGQPPKLLIYLASNLESGVPARFSGSGSGTDFTLNIHPVEEEDAATYYCQHSRELPYTFGGGTKLEIK

SEQ ID NO: 382 - protein, 15 aa, Artificial Sequence
  Description of Artificial Sequence: Synthetic peptide
  chAb17 vlCDR1
RASKSVSTSAYSYMH

SEQ ID NO: 383 - protein, 7 aa, Artificial Sequence
  Description of Artificial Sequence: Synthetic peptide
  chAb17 vlCDR2
LASNLES

SEQ ID NO: 384 - protein, 9 aa, Artificial Sequence
  Description of Artificial Sequence: Synthetic peptide
  chAb17 vlCDR3
QHSRELPYT

SEQ ID NO: 385 - protein, 118 aa, Artificial Sequence
  Description of Artificial Sequence: Synthetic polypeptide
  chAb5 Variable heavy (vh) domain
QVQLQQPGDELVKPGASVKLSCKTSGYTFTTDWMHWVKQRPGQGLEWIGMIHPNSGTTNYNEKFKSKAALTVDKSSSTACMQLSSLTSEDSAVYYCARSYWKWYFDVWGTGTTVTVSS

SEQ ID NO: 386 - protein, 5 aa, Artificial Sequence
  Description of Artificial Sequence: Synthetic peptide
  chAb5 vhCDR1
TDWMH

SEQ ID NO: 387 - protein, 17 aa, Artificial Sequence
  Description of Artificial Sequence: Synthetic peptide
  chAb5 vhCDR2
MIHPNSGTTNYNEKFKS

SEQ ID NO: 388 - protein, 9 aa, Artificial Sequence
  Description of Artificial Sequence: Synthetic peptide
  chAb5 vhCDR3
SYWKWYFDV

SEQ ID NO: 389 - protein, 106 aa, Artificial Sequence
  Description of Artificial Sequence: Synthetic polypeptide
  chAb5 Variable light (vl) domain
QIVLTQSPAIMSASLGEEITLTCSASSSVSYMHWYQQKSGTSPKLLIYSTSNLASGVPSRFSGSGSGTFYSLTISSVEAEDSADYYCHQWTSYMYTFGGGTKLEIK

SEQ ID NO: 390 - protein, 10 aa, Artificial Sequence
  Description of Artificial Sequence: Synthetic peptide
  chAb5 vlCDR1
SASSSVSYMH

SEQ ID NO: 391 - protein, 7 aa, Artificial Sequence
  Description of Artificial Sequence: Synthetic peptide
  chAb5 vlCDR2
STSNLAS

SEQ ID NO: 392 - protein, 9 aa, Artificial Sequence
  Description of Artificial Sequence: Synthetic peptide
  chAb5 vlCDR3
HQWTSYMYT

SEQ ID NO: 393 - protein, 117 aa, Artificial Sequence
  Description of Artificial Sequence: Synthetic polypeptide
  huAb3v2.5 Variable heavy (vh) domain
EVQLVQSGAEVKKPGSSVKVSCKASGYTFSSYWMHWVRQAPGQGLEWIGLIHPESGSTNYNEMFKNRATLTVDRSTSTAYMELSSLRSEDTAVYYCAGGGRLYFDYWGQGTTVTVSS

SEQ ID NO: 394 - protein, 5 aa, Artificial Sequence
  Description of Artificial Sequence: Synthetic peptide
  huAb3v2.5 vhCDR1
SYWMH

SEQ ID NO: 395 - protein, 17 aa, Artificial Sequence
  Description of Artificial Sequence: Synthetic peptide
  huAb3v2.5 vhCDR2
LIHPESGSTNYNEMFKN

SEQ ID NO: 396 - protein, 8 aa, Artificial Sequence
  Description of Artificial Sequence: Synthetic peptide
  huAb3v2.5 vhCDR3
GGRLYFDY

SEQ ID NO: 397 - protein, 112 aa, Artificial Sequence
  Description of Artificial Sequence: Synthetic polypeptide
  huAb3v2.5 Variable light (vl) domain
DIVMTQSPLSLPVTPGEPASISCRSSQSLVHSNRDTYLRWYLQKPGQSPQLLIYKVSNRFSGVPDRFSGSGSGTDFTLKISRVEAEDVGVYYCSQSTHVPYTFGGGTKVEIK

SEQ ID NO: 398 - protein, 16 aa, Artificial Sequence
  Description of Artificial Sequence: Synthetic peptide
  huAb3v2.5 vlCDR1
RSSQSLVHSNRDTYLR

SEQ ID NO: 399 - protein, 7 aa, Artificial Sequence
  Description of Artificial Sequence: Synthetic peptide
  huAb3v2.5 vlCDR2
KVSNRFS

SEQ ID NO: 400 - protein, 9 aa, Artificial Sequence
  Description of Artificial Sequence: Synthetic peptide
  huAb3v2.5 vlCDR3
SQSTHVPYT

SEQ ID NO: 401 - protein, 117 aa, Artificial Sequence; identical to SEQ ID NO: 393
  Description of Artificial Sequence: Synthetic polypeptide
  huAb3v2.6 Variable heavy (vh) domain

SEQ ID NO: 402 - protein, 5 aa, Artificial Sequence
  Description of Artificial Sequence: Synthetic peptide
  huAb3v2.6 vhCDR1
SYWMH

SEQ ID NO: 403 - protein, 17 aa, Artificial Sequence
  Description of Artificial Sequence: Synthetic peptide
  huAb3v2.6 vhCDR2
LIHPESGSTNYNEMFKN

SEQ ID NO: 404 - protein, 8 aa, Artificial Sequence
  Description of Artificial Sequence: Synthetic peptide
  huAb3v2.6 vhCDR3
GGRLYFDY

SEQ ID NO: 405 - protein, 112 aa, Artificial Sequence
  Description of Artificial Sequence: Synthetic polypeptide
  huAb3v2.6 Variable light (vl) domain
DIVMTQSPLSLPVTPGEPASISCRSSQSLVHSNQDTYLRWYLQKPGQSPQLLIYKVSNRFSGVPDRFSGSGSGTDFTLKISRVEAEDVGVYYCSQSTHVPYTFGGGTKVEIK

SEQ ID NO: 406 - protein, 16 aa, Artificial Sequence
  Description of Artificial Sequence: Synthetic peptide
  huAb3v2.6 vlCDR1
RSSQSLVHSNQDTYLR

SEQ ID NO: 407 - protein, 7 aa, Artificial Sequence
  Description of Artificial Sequence: Synthetic peptide
  huAb3v2.6 vlCDR2
KVSNRFS

SEQ ID NO: 408 - protein, 9 aa, Artificial Sequence
  Description of Artificial Sequence: Synthetic peptide
  huAb3v2.6 vlCDR3
SQSTHVPYT

SEQ ID NO: 409 - protein, 116 aa, Artificial Sequence
  Description of Artificial Sequence: Synthetic polypeptide
  huAb13v1 Variable heavy (vh) domain
EVQLQESGPGLVKPSETLSLTCAVTGYSITSGYSWHWIRQFPGNGLEWMGYIHSSGSTNYNPSLKSRISISRDTSKNQFFLKLSSVTAADTAVYYCAGYDDYFEYWGQGTTVTVSS

SEQ ID NO: 410 - protein, 6 aa, Artificial Sequence
  Description of Artificial Sequence: Synthetic peptide
  huAb13v1 vhCDR1
SGYSWH

SEQ ID NO: 411 - protein, 16 aa, Artificial Sequence
  Description of Artificial Sequence: Synthetic peptide
  huAb13v1 vhCDR2
YIHSSGSTNYNPSLKS

SEQ ID NO: 412 - protein, 7 aa, Artificial Sequence
  Description of Artificial Sequence: Synthetic peptide
  huAb13v1 vhCDR3
YDDYFEY

SEQ ID NO: 413 - protein, 107 aa, Artificial Sequence
  Description of Artificial Sequence: Synthetic polypeptide
  huAb13v1 Variable light (vl) domain
DIQMTQSPSSLSASVGDRVTITCKASQNVGFNVAWYQQKPGKSPKALIYSASYRYSGVPSRFSGSGSGTDFTLTISSLQPEDFAEYFCQQYNWYPFTFGQGTKLEIK

SEQ ID NO: 414 - protein, 11 aa, Artificial Sequence
  Description of Artificial Sequence: Synthetic peptide
  huAb13v1 vlCDR1
KASQNVGFNVA

SEQ ID NO: 415 - protein, 7 aa, Artificial Sequence
  Description of Artificial Sequence: Synthetic peptide
  huAb13v1 vlCDR2
SASYRYS

SEQ ID NO: 416 - protein, 9 aa, Artificial Sequence
  Description of Artificial Sequence: Synthetic peptide
  huAb13v1 vlCDR3
QQYNWYPFT

SEQ ID NO: 417 - protein, 119 aa, Artificial Sequence
  Description of Artificial Sequence: Synthetic polypeptide
  TPP-5706 Variable heavy (vh) domain
QVQLQQPGAELVKPGASVKMSCKASGYTFTIYNVHWIKQTPGQGLEWMGTIFPGNGDTSYNQKFKDKATLTTDKSSKTAYMQLNSLTSEDSAVYYCARWDDGNVGFAHWGQGTLVTVSA

SEQ ID NO: 418 - protein, 5 aa, Artificial Sequence
  Description of Artificial Sequence: Synthetic peptide
  TPP-5706 vhCDR1
IYNVH

SEQ ID NO: 419 - protein, 17 aa, Artificial Sequence
  Description of Artificial Sequence: Synthetic peptide
  TPP-5706 vhCDR2
TIFPGNGDTSYNQKFKD

SEQ ID NO: 420 - protein, 10 aa, Artificial Sequence
  Description of Artificial Sequence: Synthetic peptide
  TPP-5706 vhCDR3
WDDGNVGFAH

SEQ ID NO: 421 - protein, 107 aa, Artificial Sequence
  Description of Artificial Sequence: Synthetic polypeptide
  TPP-5706 Variable light (vl) domain
DIQMTQSPASLSASVGETVTITCRASENINNYLTWFQQKQGKSPQLLVYHAKTLAEGVPSRFSGSGSGTQFSLKINSLQPEDFGSYYCQHHYGTPPTFGGGTKLEIK

SEQ ID NO: 422 - protein, 11 aa, Artificial Sequence
  Description of Artificial Sequence: Synthetic peptide
  TPP-5706 vlCDR1
RASENINNYLT

SEQ ID NO: 423 - protein, 7 aa, Artificial Sequence
  Description of Artificial Sequence: Synthetic peptide
  TPP-5706 vlCDR2
HAKTLAE

SEQ ID NO: 424 - protein, 9 aa, Artificial Sequence
  Description of Artificial Sequence: Synthetic peptide
  TPP-5706 vlCDR3
QHHYGTPPT

SEQ ID NO: 425 - protein, 119 aa, Artificial Sequence
  Description of Artificial Sequence: Synthetic polypeptide
  TPP-6642 Variable heavy (vh) domain
EVQLVQSGAEVKKPGASVKVSCKASGYTFTIYNVHWVRQAPGQGLEWMGTIFPGNGDTSYNQKFKDKVTMTTDTSTSTAYMELSSLRSEDTAVYYCARWDDGNVGFAHWGQGTLVTVSS

SEQ ID NO: 426 - protein, 5 aa, Artificial Sequence
  Description of Artificial Sequence: Synthetic peptide
  TPP-6642 vhCDR1
IYNVH

SEQ ID NO: 427 - protein, 17 aa, Artificial Sequence
  Description of Artificial Sequence: Synthetic peptide
  TPP-6642 vhCDR2
TIFPGNGDTSYNQKFKD

SEQ ID NO: 428 - protein, 10 aa, Artificial Sequence
  Description of Artificial Sequence: Synthetic peptide
  TPP-6642 vhCDR3
WDDGNVGFAH

SEQ ID NO: 429 - protein, 107 aa, Artificial Sequence
  Description of Artificial Sequence: Synthetic polypeptide
  TPP-6642 Variable light (vl) domain
DIQMTQSPSSLSASVGDRVTITCRASENINNYLTWFQQKQGKSPQLLIYHAKTLAEGVPSRFSGSGSGTDFTLTISSLQPEDFATYYCQHHYGTPPTFGGGTKVEIK

SEQ ID NO: 430 - protein, 11 aa, Artificial Sequence
  Description of Artificial Sequence: Synthetic peptide
  TPP-6642 vlCDR1
RASENINNYLT

SEQ ID NO: 431 - protein, 7 aa, Artificial Sequence
  Description of Artificial Sequence: Synthetic peptide
  TPP-6642 vlCDR2
HAKTLAE

SEQ ID NO: 432 - protein, 9 aa, Artificial Sequence
  Description of Artificial Sequence: Synthetic peptide
  TPP-6642 vlCDR3
QHHYGTPPT

SEQ ID NO: 433 - protein, 119 aa, Artificial Sequence
  Description of Artificial Sequence: Synthetic polypeptide
  TPP-6850 Variable heavy (vh) domain
EVQLVQSGAEVKKPGASVKVSCKASGYTFTIYNVHWIRQAPGQGLEWMGTIFPGNGDTSYNQKFKDRATLTTDKSTKTAYMELRSLRSDDTAVYYCARWDDGNVGFAHWGQGTLVTVSS

SEQ ID NO: 434 - protein, 5 aa, Artificial Sequence
  Description of Artificial Sequence: Synthetic peptide
  TPP-6850 vhCDR1
IYNVH

SEQ ID NO: 435 - protein, 17 aa, Artificial Sequence
  Description of Artificial Sequence: Synthetic peptide
  TPP-6850 vhCDR2
TIFPGNGDTSYNQKFKD

SEQ ID NO: 436 - protein, 10 aa, Artificial Sequence
  Description of Artificial Sequence: Synthetic peptide
  TPP-6850 vhCDR3
WDDGNVGFAH

SEQ ID NO: 437 - protein, 107 aa, Artificial Sequence
  Description of Artificial Sequence: Synthetic polypeptide
  TPP-6850 Variable light (vl) domain
DIQMTQSPSSLSASVGDRVTITCRASENINNYLTWFQQKPGKAPKLLVYHAKTLAEGVPSRFSGSGSGTQFTLTISSLQPEDFATYYCQHHYGTPPTFGQGTKLEIK

SEQ ID NO: 438 - protein, 11 aa, Artificial Sequence
  Description of Artificial Sequence: Synthetic peptide
  TPP-6850 vlCDR1
RASENINNYLT

SEQ ID NO: 439 - protein, 7 aa, Artificial Sequence
  Description of Artificial Sequence: Synthetic peptide
  TPP-6850 vlCDR2
HAKTLAE

SEQ ID NO: 440 - protein, 9 aa, Artificial Sequence
  Description of Artificial Sequence: Synthetic peptide
  TPP-6850 vlCDR3
QHHYGTPPT

SEQ ID NO: 441 - protein, 118 aa, Artificial Sequence
  Description of Artificial Sequence: Synthetic polypeptide
  TPP-3803 Variable heavy (vh) domain
QVKLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTTVTVSS

SEQ ID NO: 442 - protein, 5 aa, Artificial Sequence
  Description of Artificial Sequence: Synthetic peptide
  TPP-3803 vhCDR1
NYDIN

SEQ ID NO: 443 - protein, 17 aa, Artificial Sequence
  Description of Artificial Sequence: Synthetic peptide
  TPP-3803 vhCDR2
WIFPGDGSTQYNEKFKG

SEQ ID NO: 444 - protein, 9 aa, Artificial Sequence
  Description of Artificial Sequence: Synthetic peptide
  TPP-3803 vhCDR3
QTTATWFAY

SEQ ID NO: 445 - protein, 107 aa, Artificial Sequence
  Description of Artificial Sequence: Synthetic polypeptide
  TPP-3803 Variable light (vl) domain
DIELTQSPTTLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 446 - protein, 11 aa, Artificial Sequence
  Description of Artificial Sequence: Synthetic peptide
  TPP-3803 vlCDR1
RASQSISDYLH

SEQ ID NO: 447 - protein, 7 aa, Artificial Sequence
  Description of Artificial Sequence: Synthetic peptide
  TPP-3803 vlCDR2
YASQSIS

SEQ ID NO: 448 - protein, 9 aa, Artificial Sequence
  Description of Artificial Sequence: Synthetic peptide
  TPP-3803 vlCDR3
QNGHSFPLT

SEQ ID NO: 449 - protein, 115 aa, Artificial Sequence
  Description of Artificial Sequence: Synthetic polypeptide
  TRL4542 Variable heavy (vh) domain
QVQLVESGGDLVQPGESLRLSCAASGFIFSDAWMVWVRQAPGKGLEWVGRIKTNGDGGTTDLTEPVKGRFTISRDDSKNMVYLQMNNLRTEDTAIYYCTTAPGFWGQGTLVTVSS

SEQ ID NO: 450 - protein, 5 aa, Artificial Sequence
  Description of Artificial Sequence: Synthetic peptide
  TRL4542 vhCDR1
DAWMV

SEQ ID NO: 451 - protein, 19 aa, Artificial Sequence
  Description of Artificial Sequence: Synthetic peptide
  TRL4542 vhCDR2
RIKTNGDGGTTDLTEPVKG

SEQ ID NO: 452 - protein, 4 aa, Artificial Sequence
  Description of Artificial Sequence: Synthetic peptide
  TRL4542 vhCDR3
APGF

SEQ ID NO: 453 - protein, 113 aa, Artificial Sequence
  Description of Artificial Sequence: Synthetic polypeptide
  TRL4542 Variable light (vl) domain
DIEMTQSPDSLAVSLGERATINCKSSHNLLYKSNNKNYLAWSQQKPGQPPRLLIYWASTRDSGVPDRFSGSGSGTDFTLTISSLQAEDVAVYYCHQYYGTKWTFGQGTRVEIK

SEQ ID NO: 454 - protein, 17 aa, Artificial Sequence
  Description of Artificial Sequence: Synthetic peptide
  TRL4542 vlCDR1
KSSHNLLYKSNNKNYLA

SEQ ID NO: 455 - protein, 7 aa, Artificial Sequence
  Description of Artificial Sequence: Synthetic peptide
  TRL4542 vlCDR2
WASTRDS

SEQ ID NO: 456 - protein, 9 aa, Artificial Sequence
  Description of Artificial Sequence: Synthetic peptide
  TRL4542 vlCDR3
HQYYGTKWT

SEQ ID NO: 457 - protein, 119 aa, Artificial Sequence
  Description of Artificial Sequence: Synthetic polypeptide
  h1702 Variable heavy (vh) domain
QVQLVQSGGGVVQPGTSLRLSCAASGFIFSSSAMHWVRQAPGKGLEWVAVISYDGSNKYYVDSVKGRFTISRDNSKNTLYLQMNSLRAEDTAVYYCARSARLYASFDYWGQGALVTVSS

SEQ ID NO: 458 - protein, 5 aa, Artificial Sequence
  Description of Artificial Sequence: Synthetic peptide
  h1702 vhCDR1
SSAMH

SEQ ID NO: 459 - protein, 17 aa, Artificial Sequence
  Description of Artificial Sequence: Synthetic peptide
  h1702 vhCDR2
VISYDGSNKYYVDSVKG

SEQ ID NO: 460 - protein, 10 aa, Artificial Sequence
  Description of Artificial Sequence: Synthetic peptide
  h1702 vhCDR3
SARLYASFDY

SEQ ID NO: 461 - protein, 110 aa, Artificial Sequence
  Description of Artificial Sequence: Synthetic polypeptide
  h1702 Variable light (vl) domain
QTVVTQEPSFSVSPGGTVTLTCGLSSGSVSTSHYPSWYQQTPGQAPRMLIYNTNTRSSGVPDRFSGSILGNKAALTITGAQADDESDYYCAIHVDRDIWVFGGGTKLTVL

SEQ ID NO: 462 - protein, 14 aa, Artificial Sequence
  Description of Artificial Sequence: Synthetic peptide
  h1702 vlCDR1
GLSSGSVSTSHYPS

SEQ ID NO: 463 - protein, 7 aa, Artificial Sequence
  Description of Artificial Sequence: Synthetic peptide
  h1702 vlCDR2
NTNTRSS

SEQ ID NO: 464 - protein, 10 aa, Artificial Sequence
  Description of Artificial Sequence: Synthetic peptide
  h1702 vlCDR3
AIHVDRDIWV

SEQ ID NO: 465 - protein, 119 aa, Artificial Sequence
  Description of Artificial Sequence: Synthetic polypeptide
  h1703 Variable heavy (vh) domain
QVQLQESGGGLVQPGGSLRLSCAASGFTFSSYAMSWVRQAPGKGLEWVSAISGSGGSTYYADSVKGRYTISRDNSKNTLYLQMNSLRAEDTAVYYCAKGVGPVHALDVWGQGTTVTVSS

SEQ ID NO: 466 - protein, 5 aa, Artificial Sequence
  Description of Artificial Sequence: Synthetic peptide
  h1703 vhCDR1
SYAMS

SEQ ID NO: 467 - protein, 17 aa, Artificial Sequence
  Description of Artificial Sequence: Synthetic peptide
  h1703 vhCDR2
AISGSGGSTYYADSVKG

SEQ ID NO: 468 - protein, 10 aa, Artificial Sequence
  Description of Artificial Sequence: Synthetic peptide
  h1703 vhCDR3
GVGPVHALDV

SEQ ID NO: 469 - protein, 108 aa, Artificial Sequence
  Description of Artificial Sequence: Synthetic polypeptide
  h1703 Variable light (vl) domain
DIRLTQSPSSLSASVGDRVTITCRASQSISTYLNWYQQKPGKAPILLINAVSGLQSGVPSRFSGSGSGTHFTLTITSLQPEDFATYYCQQSYSTPMWTFGQGTKVEIK

SEQ ID NO: 470 - protein, 11 aa, Artificial Sequence
  Description of Artificial Sequence: Synthetic peptide
  h1703 vlCDR1
RASQSISTYLN

SEQ ID NO: 471 - protein, 7 aa, Artificial Sequence
  Description of Artificial Sequence: Synthetic peptide
  h1703 vlCDR2
AVSGLQS

SEQ ID NO: 472 - protein, 10 aa, Artificial Sequence
  Description of Artificial Sequence: Synthetic peptide
  h1703 vlCDR3
QQSYSTPMWT

SEQ ID NO: 473 - protein, 118 aa, Artificial Sequence
  Description of Artificial Sequence: Synthetic polypeptide
  huA3 Variable heavy (vh) domain
EVQLVESGGGLVKPGGSLRLSCAASGFTFSRYGMSWVRQAPGKGLEWVSAISSGGGSIYYPDTVKGRLTISRDNAKNTLYLQMNSLRAEDTAVYYCTRHYLLFEMDYWGQGTTVTVSS

SEQ ID NO: 474 - protein, 5 aa, Artificial Sequence
  Description of Artificial Sequence: Synthetic peptide
  huA3 vhCDR1
RYGMS

SEQ ID NO: 475 - protein, 17 aa, Artificial Sequence
  Description of Artificial Sequence: Synthetic peptide
  huA3 vhCDR2
AISSGGGSIYYPDTVKG

SEQ ID NO: 476 - protein, 9 aa, Artificial Sequence
  Description of Artificial Sequence: Synthetic peptide
  huA3 vhCDR3
HYLLFEMDY

SEQ ID NO: 477 - protein, 106 aa, Artificial Sequence
  Description of Artificial Sequence: Synthetic polypeptide
  huA3 Variable light (vl) domain
DIVLTQSPSFLSASVGDRVTITCKASQNVNTAVAWYQQKPGKAPKLLIFSASNRYTGVPSRFSGSGSGTDFTLTISSLQPEDVAAYFCQQYSSSLTFGGGTKLEIK

SEQ ID NO: 478 - protein, 11 aa, Artificial Sequence
  Description of Artificial Sequence: Synthetic peptide
  huA3 vlCDR1
KASQNVNTAVA

SEQ ID NO: 479 - protein, 7 aa, Artificial Sequence
  Description of Artificial Sequence: Synthetic peptide
  huA3 vlCDR2
SASNRYT

SEQ ID NO: 480 - protein, 8 aa, Artificial Sequence
  Description of Artificial Sequence: Synthetic peptide
  huA3 vlCDR3
QQYSSSLT

SEQ ID NO: 481 - protein, 124 aa, Artificial Sequence
  Description of Artificial Sequence: Synthetic polypeptide
  huA9 Variable heavy (vh) domain
QVQLVQSGAEVKKPGASVKVSCKASGYTFTDYAMHWVKQAPGQGLEWMGVISTYYGNTNYNQKFKGRVTMTVDKSISTAYMELSRLRSDDTAVYYCARPVTTMVPRGGYYFDYWGQGTTVTVSS

SEQ ID NO: 482 - protein, 5 aa, Artificial Sequence
  Description of Artificial Sequence: Synthetic peptide
  huA9 vhCDR1
DYAMH

SEQ ID NO: 483 - protein, 17 aa, Artificial Sequence
  Description of Artificial Sequence: Synthetic peptide
  huA9 vhCDR2
VISTYYGNTNYNQKFKG

SEQ ID NO: 484 - protein, 15 aa, Artificial Sequence
  Description of Artificial Sequence: Synthetic peptide
  huA9 vhCDR3
PVTTMVPRGGYYFDY

SEQ ID NO: 485 - protein, 107 aa, Artificial Sequence
  Description of Artificial Sequence: Synthetic polypeptide
  huA9 Variable light (vl) domain
DIQLTQSPSFLSASVGDRVTITCRASKSINKYLAWYQQKPGKAPKLLIYSGSTLQSGVPSRFSGSGSGTEFTLTISSLQPEDFATYYCQQHNEYPLTFGQGTKLEIK

SEQ ID NO: 486 - protein, 11 aa, Artificial Sequence
  Description of Artificial Sequence: Synthetic peptide
  huA9 vlCDR1
RASKSINKYLA

SEQ ID NO: 487 - protein, 7 aa, Artificial Sequence
  Description of Artificial Sequence: Synthetic peptide
  huA9 vlCDR2
SGSTLQS

SEQ ID NO: 488 - protein, 9 aa, Artificial Sequence
  Description of Artificial Sequence: Synthetic peptide
  huA9 vlCDR3
QQHNEYPLT

SEQ ID NO: 489 - protein, 118 aa, Artificial Sequence
  Description of Artificial Sequence: Synthetic polypeptide
  m1704 Variable heavy (vh) domain
EVQLVESGGGLVKSGGSLKLSCAASGFTFSRYGMSWVRQTPEKRLEWVAAISSNGGSIYYPDTVKGRLTISRDNAKNTLYLQMISLRSEDTALYFCTRHYLLFEMDYWGRGTSVTVSS

SEQ ID NO: 490 - protein, 5 aa, Artificial Sequence
  Description of Artificial Sequence: Synthetic peptide
  m1704 vhCDR1
RYGMS

SEQ ID NO: 491 - protein, 17 aa, Artificial Sequence
  Description of Artificial Sequence: Synthetic peptide
  m1704 vhCDR2
AISSNGGSIYYPDTVKG

SEQ ID NO: 492 - protein, 9 aa, Artificial Sequence
  Description of Artificial Sequence: Synthetic peptide
  m1704 vhCDR3
HYLLFEMDY

SEQ ID NO: 493 - protein, 106 aa, Artificial Sequence
  Description of Artificial Sequence: Synthetic polypeptide
  m1704 Variable light (vl) domain
DIVMTQSQEFMSTTVGDRVYITCKASQNVNTAVAWYQQKPGQSPKLLIFSASNRYTGVPDRFTGSGSGTDFTLTISNVQSEDLAAYFCQQYSSSLTFGAGTKLELK

SEQ ID NO: 494 - protein, 11 aa, Artificial Sequence
  Description of Artificial Sequence: Synthetic peptide
  m1704 vlCDR1
KASQNVNTAVA

SEQ ID NO: 495 - protein, 7 aa, Artificial Sequence
  Description of Artificial Sequence: Synthetic peptide
  m1704 vlCDR2
SASNRYT

SEQ ID NO: 496 - protein, 8 aa, Artificial Sequence
  Description of Artificial Sequence: Synthetic peptide
  m1704 vlCDR3
QQYSSSLT

SEQ ID NO: 497 - protein, 119 aa, Artificial Sequence
  Description of Artificial Sequence: Synthetic polypeptide
  2E4A3.189[B7H3]_H1.1
QVQLVQSGAEVKKPGASVKVSCKASGYTFTNNYMHWVRQAPGQGLEWMGIISPSSGRTSYAQKFQGRVTMTRDTSTSTVYMELSSLRSEDTAVYYCARGGGSSPRLDYWGQGTLVTVSS

SEQ ID NO: 498 - protein, 119 aa, Artificial Sequence
  Description of Artificial Sequence: Synthetic polypeptide
  2E4A3.189[B7H3]_H1.2
QVQLVQSGAEVKKPGASVKVSCKASGYTFTDHYMHWVRQAPGQGLEWMGIISPSSGRTSYAQKFQGRVTMTRDTSTSTVYMELSSLRSEDTAVYYCARGGGSSPRLDYWGQGTLVTVSS

SEQ ID NO: 499 - protein, 119 aa, Artificial Sequence
  Description of Artificial Sequence: Synthetic polypeptide
  2E4A3.189[B7H3]_H1.3
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSS

SEQ ID NO: 500 - protein, 119 aa, Artificial Sequence
  Description of Artificial Sequence: Synthetic polypeptide
  2E4A3.189[B7H3]_H1.4
QVQLVQSGAEVKKPGASVKVSCKASGYPFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 501 - protein, 119 aa, Artificial Sequence
  Description of Artificial Sequence: Synthetic polypeptide
  2E4A3.189[B7H3]_H1.5
QVQLVQSGAEVKKPGASVKVSCKASGYTFTDHYMHWVRQAPGQGLEWMGIISPSAGSTSYAQKFQGRVTMTRDTSTSTVYMELSSLRSEDTAVYYCARGGGSSPRLDYWGQGTLVTVSS

SEQ ID NO: 502 - protein, 119 aa, Artificial Sequence
  Description of Artificial Sequence: Synthetic polypeptide
  2E4A3.189[B7H3]_H1.6
QVQLVQSGAEVKKPGASVKVSCKASGYIFTDYYMHWVRQAPGQGLEWMGIISPSGGSTDYAQKFQGRVTMTRDTSTSTVYMELSSLRSEDTAVYYCARGGGSSPRLDYWGQGTLVTVSS

SEQ ID NO: 503 - protein, 119 aa, Artificial Sequence
  Description of Artificial Sequence: Synthetic polypeptide
  2E4A3.189[B7H3]_H1.7
QVQLVQSGAEVKKPGASVKVSCKASGYTFTQNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 504 - protein, 119 aa, Artificial Sequence
  Description of Artificial Sequence: Synthetic polypeptide
  2E4A3.189[B7H3]_H1.8
QVQLVQSGAEVKKPGASVKVSCKASGYTFTDNYMHWVRQAPGQGLEWMGIISPSAGSTNYAQKFQGRVTMTRDTSTSTVYMELSSLRSEDTAVYYCARGGGSSPRLDYWGQGTLVTVSS

SEQ ID NO: 505 - protein, 119 aa, Artificial Sequence
  Description of Artificial Sequence: Synthetic polypeptide
  2E4A3.189[B7H3]_H1.9
QVQLVQSGAEVKKPGASVKVSCKASGYTFTDNYMHWVRQAPGQGLEWMGIISPSAGSTIYAQKFQGRVTMTRDTSTSTVYMELSSLRSEDTAVYYCARGGGSSPRLDYWGQGTLVTVSS

SEQ ID NO: 506 - protein, 119 aa, Artificial Sequence
  Description of Artificial Sequence: Synthetic polypeptide
  2E4A3.189[B7H3]_H1.10
QVQLVQSGAEVKKPGASVKVSCKASGYTFTNHYMHWVRQAPGQGLEWMGIISPSVGSTSYAQKFQGRVTMTRDTSTSTVYMELSSLRSEDTAVYYCARGGGSSPRLDYWGQGTLVTVSS

SEQ ID NO: 507 - protein, 119 aa, Artificial Sequence
  Description of Artificial Sequence: Synthetic polypeptide
  2E4A3.189[B7H3]_H1.11
QVQLVQSGAEVKKPGASVKVSCKASGYTFIDFYMHWVRQAPGQGLEWMGIISPSGGSTDYAQKFQGRVTMTRDTSTSTVYMELSSLRSEDTAVYYCARGGGSSPRLDYWGQGTLVTVSS

SEQ ID NO: 508 - protein, 119 aa, Artificial Sequence
  Description of Artificial Sequence: Synthetic polypeptide
  2E4A3.189[B7H3]_H1.12
QVQLVQSGAEVKKPGASVKVSCKASGYTFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 509 - protein, 119 aa, Artificial Sequence
  Description of Artificial Sequence: Synthetic polypeptide
  2E4A3.189[B7H3]_H1.13
QVQLVQSGAEVKKPGASVKVSCKASGYPFTDHYMHWVRQAPGQGLEWMGIISPSAGSTSYAQKFQGRVTMTRDTSTSTVYMELSSLRSEDTAVYYCARGGGSSPRLDYWGQGTLVTVSS

SEQ ID NO: 510 - protein, 119 aa, Artificial Sequence
  Description of Artificial Sequence: Synthetic polypeptide
  2E4A3.189[B7H3]_H1.14
QVQLVQSGAEVKKPGASVKVSCKASGYTFTENYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 511 - protein, 119 aa, Artificial Sequence
  Description of Artificial Sequence: Synthetic polypeptide
  2E4A3.189[B7H3]_H1.15
QVQLVQSGAEVKKPGASVKVSCKASGYTFINHYMHWVRQAPGQGLEWMGIISPSAGSTNYAQKFQGRVTMTRDTSTSTVYMELSSLRSEDTAVYYCARGGGSSPRLDYWGQGTLVTVSS

SEQ ID NO: 512 - protein, 119 aa, Artificial Sequence
  Description of Artificial Sequence: Synthetic polypeptide
  2E4A3.189[B7H3]_H1.16
QVQLVQSGAEVKKPGASVKVSCKASGYTFTEFYMHWVRQAPGQGLEWMGIISPSGGSTDYAQKFQGRVTMTRDTSTSTVYMELSSLRSEDTAVYYCARGGGSSPRLDYWGQGTLVTVSS

SEQ ID NO: 513 - protein, 119 aa, Artificial Sequence
  Description of Artificial Sequence: Synthetic polypeptide
  2E4A3.189[B7H3]_H1.17
QVQLVQSGAEVKKPGASVKVSCKASGYTFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 514 - protein, 119 aa, Artificial Sequence
  Description of Artificial Sequence: Synthetic polypeptide
  2E4A3.189[B7H3]_H1.18
QVQLVQSGAEVKKPGASVKVSCKASGYIFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 515 - protein, 119 aa, Artificial Sequence
  Description of Artificial Sequence: Synthetic polypeptide
  2E4A3.189[B7H3]_H1.19
QVQLVQSGAEVKKPGASVKVSCKASGYTFINNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 516 - protein, 119 aa, Artificial Sequence
  Description of Artificial Sequence: Synthetic polypeptide
  2E4A3.189[B7H3]_H1.20
QVQLVQSGAEVKKPGASVKVSCKASGYIFTNNYMHWVRQAPGQGLEWMGIISPSVGRTSYAQKFQGRVTMTRDTSTSTVYMELSSLRSEDTAVYYCARGGGSSPRLDYWGQGTLVTVSS

SEQ ID NO: 517 - protein, 119 aa, Artificial Sequence
  Description of Artificial Sequence: Synthetic polypeptide
  2E4A3.189[B7H3]_H1.21
QVQLVQSGAEVKKPGASVKVSCKASGYAFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 518 - protein, 119 aa, Artificial Sequence
  Description of Artificial Sequence: Synthetic polypeptide
  2E4A3.189[B7H3]_H1.22
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSS

SEQ ID NO: 519 - protein, 119 aa, Artificial Sequence
  Description of Artificial Sequence: Synthetic polypeptide
  2E4A3.189[B7H3]_H1.23
QVQLVQSGAEVKKPGASVKVSCKASGYAFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 520 - protein, 119 aa, Artificial Sequence
  Description of Artificial Sequence: Synthetic polypeptide
  2E4A3.189[B7H3]_H1.24
QVQLVQSGAEVKKPGASVKVSCKASGYIFTDNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 521 - protein, 119 aa, Artificial Sequence
  Description of Artificial Sequence: Synthetic polypeptide
  2E4A3.189[B7H3]_H1.25
QVQLVQSGAEVKKPGASVKVSCKASGYAFTDNYMHWVRQAPGQGLEWMGIISPSAGSTDYAQKFQGRVTMTRDTSTSTVYMELSSLRSEDTAVYYCARGGGSSPRLDYWGQGTLVTVSS

SEQ ID NO: 522 - protein, 119 aa, Artificial Sequence
  Description of Artificial Sequence: Synthetic polypeptide
  2E4A3.189[B7H3]_H1.26
QVQLVQSGAEVKKPGASVKVSCKASGYIFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 523 - protein, 119 aa, Artificial Sequence
  Description of Artificial Sequence: Synthetic polypeptide
  2E4A3.189[B7H3]_H1.27
QVQLVQSGAEVKKPGASVKVSCKASGYAFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 524 - protein, 119 aa, Artificial Sequence
  Description of Artificial Sequence: Synthetic polypeptide
  2E4A3.189[B7H3]_H1.28
QVQLVQSGAEVKKPGASVKVSCKASGYSFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 525 - protein, 119 aa, Artificial Sequence
  Description of Artificial Sequence: Synthetic polypeptide
  2E4A3.189[B7H3]_H1.29
QVQLVQSGAEVKKPGASVKVSCKASGYAFTNHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 526 - protein, 119 aa, Artificial Sequence
  Description of Artificial Sequence: Synthetic polypeptide
  2E4A3.189[B7H3]_H1.30
QVQLVQSGAEVKKPGASVKVSCKASGYTFTNNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 527 - protein, 119 aa, Artificial Sequence
  Description of Artificial Sequence: Synthetic polypeptide
  2E4A3.189[B7H3]_H1.31
QVQLVQSGAEVKKPGASVKVSCKASGYTFINNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 528 - protein, 119 aa, Artificial Sequence
  Description of Artificial Sequence: Synthetic polypeptide
  2E4A3.189[B7H3]_H1.32
QVQLVQSGAEVKKPGASVKVSCKASGYSFTNNYMHWVRQAPGQGLEWMGIISPSTGRTSYAQKFQGRVTMTRDTSTSTVYMELSSLRSEDTAVYYCARGGGSSPRLDYWGQGTLVTVSS

SEQ ID NO: 529 - protein, 119 aa, Artificial Sequence
  Description of Artificial Sequence: Synthetic polypeptide
  2E4A3.189[B7H3]_H1.33
QVQLVQSGAEVKKPGASVKVSCKASGYTFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 530 - protein, 119 aa, Artificial Sequence
  Description of Artificial Sequence: Synthetic polypeptide
  2E4A3.189[B7H3]_H1.34
QVQLVQSGAEVKKPGASVKVSCKASGYTFTDNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 531 - protein, 119 aa, Artificial Sequence
  Description of Artificial Sequence: Synthetic polypeptide
  2E4A3.189[B7H3]_H1.35
QVQLVQSGAEVKKPGASVKVSCKASGYTFTDNYMHWVRQAPGQGLEWMGIISPSVGTTAYAQKFQGRVTMTRDTSTSTVYMELSSLRSEDTAVYYCARGGGSSPRLDYWGQGTLVTVSS

SEQ ID NO: 532 - protein, 119 aa, Artificial Sequence
  Description of Artificial Sequence: Synthetic polypeptide
  2E4A3.189[B7H3]_H1.36
QVQLVQSGAEVKKPGASVKVSCKASGYPFINHYMHWVRQAPGQGLEWMGIISPSSGRTAYAQKFQGRVTMTRDTSTSTVYMELSSLRSEDTAVYYCARGGGSSPRLDYWGQGTLVTVSS

SEQ ID NO: 533 - protein, 119 aa, Artificial Sequence
  Description of Artificial Sequence: Synthetic polypeptide
  2E4A3.189[B7H3]_H1.37
QVQLVQSGAEVKKPGASVKVSCKASGYTFTNHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 534 - protein, 119 aa, Artificial Sequence
  Description of Artificial Sequence: Synthetic polypeptide
  2E4A3.189[B7H3]_H1.38
QVQLVQSGAEVKKPGASVKVSCKASGYSFTNHYMHWVRQAPGQGLEWMGIISPSVGRTSYAQKFQGRVTMTRDTSTSTVYMELSSLRSEDTAVYYCARGGGSSPRLDYWGQGTLVTVSS

SEQ ID NO: 535 - protein, 119 aa, Artificial Sequence
  Description of Artificial Sequence: Synthetic polypeptide
  2E4A3.189[B7H3]_H1.39
QVQLVQSGAEVKKPGASVKVSCKASGYTFINHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 536 - protein, 119 aa, Artificial Sequence
  Description of Artificial Sequence: Synthetic polypeptide
  2E4A3.189[B7H3]_H1.40
QVQLVQSGAEVKKPGASVKVSCKASGYSFTDNYMHWVRQAPGQGLEWMGIISPSGGSTAYAQKFQGRFTMTRDTSTSTVYMELSSLRSEDTAVYYCARGGGSSPRLDYWGQGTLVTVSS

SEQ ID NO: 537 - protein, 119 aa, Artificial Sequence
  Description of Artificial Sequence: Synthetic polypeptide
  2E4A3.189[B7H3]_H1.41
QVQLVQSGAEVKKPGASVKVSCKASGYIFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 538 - protein, 119 aa, Artificial Sequence
  Description of Artificial Sequence: Synthetic polypeptide
  2E4A3.189[B7H3]_H1.42
QVQLVQSGAEVKKPGASVKVSCKASGYTFIDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 539 - protein, 119 aa, Artificial Sequence
  Description of Artificial Sequence: Synthetic polypeptide
  2E4A3.189[B7H3]_H1.43
QVQLVQSGAEVKKPGASVKVSCKASGYSFTDNYMHWVRQAPGQGLEWMGIISPSSGRTSYAQKFQGRVTMTRDTSTSTVYMELSSLRSEDTAVYYCARGGGSSPRLDYWGQGTLVTVSS

SEQ ID NO: 540 - protein, 119 aa, Artificial Sequence
  Description of Artificial Sequence: Synthetic polypeptide
  2E4A3.189[B7H3]_H1.44
QVQLVQSGAEVKKPGASVKVSCKASGYIFTNNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 541 - protein, 119 aa, Artificial Sequence
  Description of Artificial Sequence: Synthetic polypeptide
  2E4A3.189[B7H3]_H1.45
QVQLVQSGAEVKKPGASVKVSCKASGYAFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 542 - protein, 119 aa, Artificial Sequence
  Description of Artificial Sequence: Synthetic polypeptide
  2E4A3.189[B7H3]_H1.46
QVQLVQSGAEVKKPGASVKVSCKASGYSFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 543 - protein, 119 aa, Artificial Sequence
  Description of Artificial Sequence: Synthetic polypeptide
  2E4A3.189[B7H3]_H1.47
QVQLVQSGAEVKKPGASVKVSCKASGYIFTDHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 544 - protein, 119 aa, Artificial Sequence
  Description of Artificial Sequence: Synthetic polypeptide
  2E4A3.189[B7H3]_H1.48
QVQLVQSGAEVKKPGASVKVSCKASGYSFTDNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 545 - protein, 119 aa, Artificial Sequence
  Description of Artificial Sequence: Synthetic polypeptide
  2E4A3.189[B7H3]_H1.49
QVQLVQSGAEVKKPGASVKVSCKASGYSFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 546 - protein, 119 aa, Artificial Sequence
  Description of Artificial Sequence: Synthetic polypeptide
  2E4A3.189[B7H3]_H1.50
QVQLVQSGAEVKKPGASVKVSCKASGYSFTNNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 547 - protein, 119 aa, Artificial Sequence
  Description of Artificial Sequence: Synthetic polypeptide
  2E4A3.189[B7H3]_H1.51
QVQLVQSGAEVKKPGASVKVSCKASGYTFTDNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 548 - protein, 119 aa, Artificial Sequence
  Description of Artificial Sequence: Synthetic polypeptide
  2E4A3.189[B7H3]_H1.52
QVQLVQSGAEVKKPGASVKVSCKASGYSFTDHYMHWVRQAPGQGLEWMGIISPSSGRTDYAQKFQGRVTMTRDTSTSTVYMELSSLRSEDTAVYYCARGGGSSPRLDYWGQGTLVTVSS

SEQ ID NO: 549 - protein, 119 aa, Artificial Sequence
  Description of Artificial Sequence: Synthetic polypeptide
  2E4A3.189[B7H3]_H1.53
QVQLVQSGAEVKKPGASVKVSCKASGYTFTNNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 550 - protein, 119 aa, Artificial Sequence
  Description of Artificial Sequence: Synthetic polypeptide
  2E4A3.189[B7H3]_H1.54
QVQLVQSGAEVKKPGASVKVSCKASGYTFIDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 551 - protein, 119 aa, Artificial Sequence
  Description of Artificial Sequence: Synthetic polypeptide
  2E4A3.189[B7H3]_H1.55
QVQLVQSGAEVKKPGASVKVSCKASGYIFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 552 - protein, 119 aa, Artificial Sequence
  Description of Artificial Sequence: Synthetic polypeptide
  2E4A3.189[B7H3]_H1.56
QVQLVQSGAEVKKPGASVKVSCKASGYTFTNNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 553 - protein, 119 aa, Artificial Sequence
  Description of Artificial Sequence: Synthetic polypeptide
  2E4A3.189[B7H3]_H1.57
QVQLVQSGAEVKKPGASVKVSCKASGYIFTNHYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 554 - protein, 119 aa, Artificial Sequence
  Description of Artificial Sequence: Synthetic polypeptide
  2E4A3.189[B7H3]_H1.58
QVQLVQSGAEVKKPGASVKVSCKASGYTFTNHYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 555 - protein, 119 aa, Artificial Sequence
  Description of Artificial Sequence: Synthetic polypeptide
  2E4A3.189[B7H3]_H1.59
QVQLVQSGAEVKKPGASVKVSCKASGYPFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 556 - protein, 119 aa, Artificial Sequence
  Description of Artificial Sequence: Synthetic polypeptide
  2E4A3.189[B7H3]_H1.60
QVQLVQSGAEVKKPGASVKVSCKASGYTFTDNYMHWVRQAPGQGLEWMGIISPSGGTTAYAQKFQGRVTMTRDTSTSTVYMELSSLRSEDTAVYYCARGGGSSPRLDYWGQGTLVTVSS

SEQ ID NO: 557 - protein, 119 aa, Artificial Sequence
  Description of Artificial Sequence: Synthetic polypeptide
  2E4A3.189[B7H3]_H1.61
QVQLVQSGAEVKKPGASVKVSCKASGYTFINNYMHWVRQAPGQGLEWMGIISPIAGSTDYAQKFQGRVTMTRDTSTSTVYMELSSLRSEDTAVYYCARGGGSSPRLDYWGQGTLVTVSS

SEQ ID NO: 558 - protein, 119 aa, Artificial Sequence
  Description of Artificial Sequence: Synthetic polypeptide
  2E4A3.189[B7H3]_H1.62
QVQLVQSGAEVKKPGASVKVSCKASGYAFTNNYMHWVRQAPGQGLEWMGIISPSVGRTAYAQKFQGRVTMTRDTSTSTVYMELSSLRSEDTAVYYCARGGGSSPRLDYWGQGTLVTVSS

SEQ ID NO: 559 - protein, 119 aa, Artificial Sequence
  Description of Artificial Sequence: Synthetic polypeptide
  2E4A3.189[B7H3]_H1.63
QVQLVQSGAEVKKPGASVKVSCKASGYIFTNNYMHWVRQAPGQGLEWMGIIAPSVGRTAYAQKFQGRVTMTRDTSTSTVYMELSSLRSEDTAVYYCARGGGSSPRLDYWGQGTLVTVSS

SEQ ID NO: 560 - protein, 119 aa, Artificial Sequence; identical to SEQ ID NO: 516
  Description of Artificial Sequence: Synthetic polypeptide
  2E4A3.189[B7H3]_H1.64

SEQ ID NO: 561 - protein, 119 aa, Artificial Sequence
  Description of Artificial Sequence: Synthetic polypeptide
  2E4A3.189[B7H3]_H1.65
QVQLVQSGAEVKKPGASVKVSCKASGYIFTNNYMHWVRQAPGQGLEWMGIISPVVGRTAYAQKFQGRVTMTRDTSTSTVYMELSSLRSEDTAVYYCARGGGSSPRLDYWGQGTLVTVSS

SEQ ID NO: 562 - protein, 119 aa, Artificial Sequence
  Description of Artificial Sequence: Synthetic polypeptide
  2E4A3.189[B7H3]_H1.66
QVQLVQSGAEVKKPGASVKVSCKASGYGFTNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 563 - protein, 119 aa, Artificial Sequence
  Description of Artificial Sequence: Synthetic polypeptide
  2E4A3.189[B7H3]_H1.67
QVQLVQSGAEVKKPGASVKVSCKASGYIFTNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 564 - protein, 119 aa, Artificial Sequence
  Description of Artificial Sequence: Synthetic polypeptide
  2E4A3.189[B7H3]_H1.68
QVQLVQSGAEVKKPGASVKVSCKASGYLFTNNYMHWVRQAPGQGLEWMGIISPSVGRTAYAQKFQGRVTMTRDTSTSTVYMELSSLRSEDTAVYYCARGGGSSPRLDYWGQGTLVTVSS

SEQ ID NO: 565 - protein, 119 aa, Artificial Sequence
  Description of Artificial Sequence: Synthetic polypeptide
  2E4A3.189[B7H3]_H1.69
QVQLVQSGAEVKKPGASVKVSCKASGYIFTNNYMHWVRQAPGQGLEWMGIISPQVGRTAYAQKFQGRVTMTRDTSTSTVYMELSSLRSEDTAVYYCARGGGSSPRLDYWGQGTLVTVSS

SEQ ID NO: 566 - protein, 119 aa, Artificial Sequence
  Description of Artificial Sequence: Synthetic polypeptide
  2E4A3.189[B7H3]_H1.70
QVQLVQSGAEVKKPGASVKVSCKASGYFFTNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 567 - protein, 119 aa, Artificial Sequence
  Description of Artificial Sequence: Synthetic polypeptide
  2E4A3.189[B7H3]_H1.71
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRSDYWGQGTLVTVSS

SEQ ID NO: 568 - protein, 119 aa, Artificial Sequence
  Description of Artificial Sequence: Synthetic polypeptide
  2E4A3.189[B7H3]_H1.72
QVQLVQSGAEVKKPGASVKVSCKASGYIFVINYMHWVRQAPGQGLEWMGIISPAVGRTAYAQKFQGRVTMTRDTSTSTVYMELSSLRSEDTAVYYCARGGGSSPRLDYWGQGTLVTVSS

SEQ ID NO: 569 - protein, 119 aa, Artificial Sequence
  Description of Artificial Sequence: Synthetic polypeptide
  2E4A3.189[B7H3]_H1.73
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGFSSPRVDYWGQGTLVTVSS

SEQ ID NO: 570 - protein, 119 aa, Artificial Sequence
  Description of Artificial Sequence: Synthetic polypeptide
  2E4A3.189[B7H3]_H1.74
QVQLVQSGAEVKKPGASVKVSCKASGYSFKNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 571 - protein, 119 aa, Artificial Sequence
  Description of Artificial Sequence: Synthetic polypeptide
  2E4A3.189[B7H3]_H1.75
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRGDYWGQGTLVTVSS

SEQ ID NO: 572 - protein, 119 aa, Artificial Sequence
  Description of Artificial Sequence: Synthetic polypeptide
  2E4A3.189[B7H3]_H1.76
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRVDYWGQGTLVTVSS

SEQ ID NO: 573 - protein, 119 aa, Artificial Sequence
  Description of Artificial Sequence: Synthetic polypeptide
  2E4A3.189[B7H3]_H1.77
QVQLVQSGAEVKKPGASVKVSCKASGYGFTNNYMHWVRQAPGQGLEWMGIISPVVGRTAYAQKFQGRVTMTRDTSTSTVYMELSSLRSEDTAVYYCARGGGSSPRLDYWGQGTLVTVSS

SEQ ID NO: 574 - protein, 119 aa, Artificial Sequence
  Description of Artificial Sequence: Synthetic polypeptide
  2E4A3.189[B7H3]_H1.78
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARAGWSSPRLDYWGQGTLVTVSS

SEQ ID NO: 575 - protein, 119 aa, Artificial Sequence
  Description of Artificial Sequence: Synthetic polypeptide
  2E4A3.189[B7H3]_H1.79
QVQLVQSGAEVKKPGASVKVSCKASGYIFENNYMHWVRQAPGQGLEWMGIISPSVGRWAYAQKFQGRVTMTRDTSTSTVYMELSSLRSEDTAVYYCARGGGSSPRLDYWGQGTLVTVSS

SEQ ID NO: 576 - protein, 119 aa, Artificial Sequence
  Description of Artificial Sequence: Synthetic polypeptide
  2E4A3.189[B7H3]_H1.80
QVQLVQSGAEVKKPGASVKVSCKASGYIFTNVYMHWVRQAPGQGLEWMGIIFPGVGRTAYAQKFQGRVTMTRDTSTSTVYMELSSLRSEDTAVYYCARGGGSSPRLDYWGQGTLVTVSS

SEQ ID NO: 577 - protein, 119 aa, Artificial Sequence
  Description of Artificial Sequence: Synthetic polypeptide
  2E4A3.189[B7H3]_H1.81
QVQLVQSGAEVKKPGASVKVSCKASGYIFVFNYMHWVRQAPGQGLEWMGIISPSVGRTDYAQKFQGRVTMTRDTSTSTVYMELSSLRSEDTAVYYCARGGGSSPRLDYWGQGTLVTVSS

SEQ ID NO: 578 - protein, 119 aa, Artificial Sequence
  Description of Artificial Sequence: Synthetic polypeptide
  2E4A3.189[B7H3]_H1.82
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGLSSPRQDYWGQGTLVTVSS

SEQ ID NO: 579 - protein, 119 aa, Artificial Sequence
  Description of Artificial Sequence: Synthetic polypeptide
  2E4A3.189[B7H3]_H1.83
QVQLVQSGAEVKKPGASVKVSCKASGYIFVNNYMHWVRQAPGQGLEWMGIISPSVGRILYAQKFQGRVTMTRDTSTSTVYMELSSLRSEDTAVYYCARGGGSSPRLDYWGQGTLVTVSS

SEQ ID NO: 580 - protein, 119 aa, Artificial Sequence
  Description of Artificial Sequence: Synthetic polypeptide
  2E4A3.189[B7H3]_H1.84
QVQLVQSGAEVKKPGASVKVSCKASGYIFSNNYMHWVRQAPGQGLEWMGIISPSVGRTQYAQKFQGRVTMTRDTSTSTVYMELSSLRSEDTAVYYCARGGGSSPRLDYWGQGTLVTVSS

SEQ ID NO: 581 - protein, 119 aa, Artificial Sequence
  Description of Artificial Sequence: Synthetic polypeptide
  2E4A3.189[B7H3]_H1.85
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGMSSPRVDYWGQGTLVTVSS

SEQ ID NO: 582 - protein, 119 aa, Artificial Sequence
  Description of Artificial Sequence: Synthetic polypeptide
  2E4A3.189[B7H3]_H1.86
QVQLVQSGAEVKKPGASVKVSCKASGLGFTNNYMHWVRQAPGQGLEWMGILSPAVGRTAYAQKFQGRVTMTRDTSTSTVYMELSSLRSEDTAVYYCARGGGSSPRLDYWGQGTLVTVSS

SEQ ID NO: 583 - protein, 119 aa, Artificial Sequence
  Description of Artificial Sequence: Synthetic polypeptide
  2E4A3.189[B7H3]_H1.87
QVQLVQSGAEVKKPGASVKVSCKASGYIFTNNYMHWVRQAPGQGLEWMGIIGPAVGRTAYAQKFQGRVTMTRDTSTSTVYMELSSLRSEDTAVYYCARGGGSSPRLDYWGQGTLVTVSS

SEQ ID NO: 584 - protein, 119 aa, Artificial Sequence
  Description of Artificial Sequence: Synthetic polypeptide
  2E4A3.189[B7H3]_H1.88
QVQLVQSGAEVKKPGASVKVSCKASGYIFTNNYMHWVRQAPGQGLEWMGILSPVVGRTAYAQKFQGRVTMTRDTSTSTVYMELSSLRSEDTAVYYCARGGGSSPRLDYWGQGTLVTVSS

SEQ ID NO: 585 - protein, 121 aa, Artificial Sequence
  Description of Artificial Sequence: Synthetic polypeptide
  1A7[CD28]_H1.1
EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSS

SEQ ID NO: 586 - protein, 121 aa, Artificial Sequence
  Description of Artificial Sequence: Synthetic polypeptide
  1A7[CD28]_H1.2
EVQLLESGGGLVQPGGSLRLSCAASGFTFSSYAMSWVRQAPGKGLEWVSTIDGSGDSTYYADSVKGRFTISRDNSKNTLYLQMNSLRAEDTAVYYCAKSGPGLRQVGFDYWGQGTLVTVSS

SEQ ID NO: 587 - protein, 121 aa, Artificial Sequence
  Description of Artificial Sequence: Synthetic polypeptide
  1A7[CD28]_H1.3
EVQLLESGGGLVQPGGSLRLSCAASGFTFSSYAMSWVRQAPGKGLEWVSTIEGSGDSTYYADSVKGRFTISRDNSKNTLYLQMNSLRAEDTAVYYCAKSGPGLRQVGFDYWGQGTLVTVSS

SEQ ID NO: 588 - protein, 121 aa, Artificial Sequence
  Description of Artificial Sequence: Synthetic polypeptide
  1A7[CD28]_H1.4
EVQLLESGGGLVQPGGSLRLSCAASGFTFSSYAMSWVRQAPGKGLEWVSTIYGSGDSTYYADSVKGRFTISRDNSKNTLYLQMNSLRAEDTAVYYCAKSGPGLRQVGFDYWGQGTLVTVSS

SEQ ID NO: 589 - protein, 121 aa, Artificial Sequence
  Description of Artificial Sequence: Synthetic polypeptide
  1A7[CD28]_H1.5
EVQLLESGGGLVQPGGSLRLSCAASGFTFSSYAMSWVRQAPGKGLEWVSTISDSGDSTYYADSVKGRFTISRDNSKNTLYLQMNSLRAEDTAVYYCAKSGPGLRQVGFDYWGQGTLVTVSS

SEQ ID NO: 590 - protein, 121 aa, Artificial Sequence
  Description of Artificial Sequence: Synthetic polypeptide
  1A7[CD28]_H1.6
EVQLLESGGGLVQPGGSLRLSCAASGFTFSSYAMSWVRQAPGKGLEWVSTISESGDSTYYADSVKGRFTISRDNSKNTLYLQMNSLRAEDTAVYYCAKSGPGLRQVGFDYWGQGTLVTVSS

SEQ ID NO: 591 - protein, 121 aa, Artificial Sequence
  Description of Artificial Sequence: Synthetic polypeptide
  1A7[CD28]_H1.7
EVQLLESGGGLVQPGGSLRLSCAASGFTFSSYAMSWVRQAPGKGLEWVSTISGSGTSTYYADSVKGRFTISRDNSKNTLYLQMNSLRAEDTAVYYCAKSGPGLRQVGFDYWGQGTLVTVSS

SEQ ID NO: 592 - protein, 121 aa, Artificial Sequence
  Description of Artificial Sequence: Synthetic polypeptide
  1A7[CD28]_H1.8
EVQLLESGGGLVQPGGSLRLSCAASGFTFSSYAMSWVRQAPGKGLEWVSTISGSGYSTYYADSVKGRFTISRDNSKNTLYLQMNSLRAEDTAVYYCAKSGPGLRQVGFDYWGQGTLVTVSS

SEQ ID NO: 593 - protein, 121 aa, Artificial Sequence
  Description of Artificial Sequence: Synthetic polypeptide
  1A7[CD28]_H1.9
EVQLLESGGGLVQPGGSLRLSCAASGFTFSSYAMSWVRQAPGKGLEWVSTISGSGDYTYYADSVKGRFTISRDNSKNTLYLQMNSLRAEDTAVYYCAKSGPGLRQVGFDYWGQGTLVTVSS

SEQ ID NO: 594 - protein, 121 aa, Artificial Sequence
  Description of Artificial Sequence: Synthetic polypeptide
  1A7[CD28]_H1.10
EVQLLESGGGLVQPGGSLRLSCAASGFTFSSYYMSWVRQAPGKGLEWVSTIDGSGDSTYYADSVKGRFTISRDNSKNTLYLQMNSLRAEDTAVYYCAKSGPGLRQVGFDYWGQGTLVTVSS

SEQ ID NO: 595 - protein, 121 aa, Artificial Sequence
  Description of Artificial Sequence: Synthetic polypeptide
  1A7[CD28]_H1.11
EVQLLESGGGLVQPGGSLRLSCAASGFTFSSYYMSWVRQAPGKGLEWVSTIEGSGDSTYYADSVKGRFTISRDNSKNTLYLQMNSLRAEDTAVYYCAKSGPGLRQVGFDYWGQGTLVTVSS

SEQ ID NO: 596 - protein, 121 aa, Artificial Sequence
  Description of Artificial Sequence: Synthetic polypeptide
  1A7[CD28]_H1.12
EVQLLESGGGLVQPGGSLRLSCAASGFTFSSYYMSWVRQAPGKGLEWVSTIYGSGDSTYYADSVKGRFTISRDNSKNTLYLQMNSLRAEDTAVYYCAKSGPGLRQVGFDYWGQGTLVTVSS

SEQ ID NO: 597 - protein, 121 aa, Artificial Sequence
  Description of Artificial Sequence: Synthetic polypeptide
  1A7[CD28]_H1.13
EVQLLESGGGLVQPGGSLRLSCAASGFTFSSYYMSWVRQAPGKGLEWVSTISDSGDSTYYADSVKGRFTISRDNSKNTLYLQMNSLRAEDTAVYYCAKSGPGLRQVGFDYWGQGTLVTVSS

SEQ ID NO: 598 - protein, 121 aa, Artificial Sequence
  Description of Artificial Sequence: Synthetic polypeptide
  1A7[CD28]_H1.14
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSS

SEQ ID NO: 599 - protein, 121 aa, Artificial Sequence
  Description of Artificial Sequence: Synthetic polypeptide
  1A7[CD28]_H1.15
EVQLLESGGGLVQPGGSLRLSCAASGFTFSSYYMSWVRQAPGKGLEWVSTISGSGTSTYYADSVKGRFTISRDNSKNTLYLQMNSLRAEDTAVYYCAKSGPGLRQVGFDYWGQGTLVTVSS

SEQ ID NO: 600 - protein, 121 aa, Artificial Sequence
  Description of Artificial Sequence: Synthetic polypeptide
  1A7[CD28]_H1.16
EVQLLESGGGLVQPGGSLRLSCAASGFTFSSYYMSWVRQAPGKGLEWVSTISGSGYSTYYADSVKGRFTISRDNSKNTLYLQMNSLRAEDTAVYYCAKSGPGLRQVGFDYWGQGTLVTVSS

SEQ ID NO: 601 - protein, 121 aa, Artificial Sequence
  Description of Artificial Sequence: Synthetic polypeptide
  1A7[CD28]_H1.17
EVQLLESGGGLVQPGGSLRLSCAASGFTFSSYYMSWVRQAPGKGLEWVSTISGSGDYTYYADSVKGRFTISRDNSKNTLYLQMNSLRAEDTAVYYCAKSGPGLRQVGFDYWGQGTLVTVSS

SEQ ID NO: 602 - protein, 121 aa, Artificial Sequence
  Description of Artificial Sequence: Synthetic polypeptide
  1A7[CD28]_H1.18
EVQLLESGGGLVQPGGSLRLSCAASGFTFSSYAMSWVRQAPGKGLEWVSTIDDSGDSTYYADSVKGRFTISRDNSKNTLYLQMNSLRAEDTAVYYCAKSGPGLRQVGFDYWGQGTLVTVSS

SEQ ID NO: 603 - protein, 121 aa, Artificial Sequence
  Description of Artificial Sequence: Synthetic polypeptide
  1A7[CD28]_H1.19
EVQLLESGGGLVQPGGSLRLSCAASGFTFSSYAMSWVRQAPGKGLEWVSTIDESGDSTYYADSVKGRFTISRDNSKNTLYLQMNSLRAEDTAVYYCAKSGPGLRQVGFDYWGQGTLVTVSS

SEQ ID NO: 604 - protein, 121 aa, Artificial Sequence
  Description of Artificial Sequence: Synthetic polypeptide
  1A7[CD28]_H1.20
EVQLLESGGGLVQPGGSLRLSCAASGFTFSSYAMSWVRQAPGKGLEWVSTIDGSGTSTYYADSVKGRFTISRDNSKNTLYLQMNSLRAEDTAVYYCAKSGPGLRQVGFDYWGQGTLVTVSS

SEQ ID NO: 605 - protein, 121 aa, Artificial Sequence
  Description of Artificial Sequence: Synthetic polypeptide
  1A7[CD28]_H1.21
EVQLLESGGGLVQPGGSLRLSCAASGFTFSSYAMSWVRQAPGKGLEWVSTIDGSGYSTYYADSVKGRFTISRDNSKNTLYLQMNSLRAEDTAVYYCAKSGPGLRQVGFDYWGQGTLVTVSS

SEQ ID NO: 606 - protein, 121 aa, Artificial Sequence
  Description of Artificial Sequence: Synthetic polypeptide
  1A7[CD28]_H1.22
EVQLLESGGGLVQPGGSLRLSCAASGFTFSSYAMSWVRQAPGKGLEWVSTIDGSGDYTYYADSVKGRFTISRDNSKNTLYLQMNSLRAEDTAVYYCAKSGPGLRQVGFDYWGQGTLVTVSS

SEQ ID NO: 607 - protein, 121 aa, Artificial Sequence
  Description of Artificial Sequence: Synthetic polypeptide
  1A7[CD28]_H1.23
EVQLLESGGGLVQPGGSLRLSCAASGFTFSSYAMSWVRQAPGKGLEWVSTIEDSGDSTYYADSVKGRFTISRDNSKNTLYLQMNSLRAEDTAVYYCAKSGPGLRQVGFDYWGQGTLVTVSS

SEQ ID NO: 608 - protein, 121 aa, Artificial Sequence
  Description of Artificial Sequence: Synthetic polypeptide
  1A7[CD28]_H1.24
EVQLLESGGGLVQPGGSLRLSCAASGFTFSSYAMSWVRQAPGKGLEWVSTIEESGDSTYYADSVKGRFTISRDNSKNTLYLQMNSLRAEDTAVYYCAKSGPGLRQVGFDYWGQGTLVTVSS

SEQ ID NO: 609 - protein, 121 aa, Artificial Sequence
  Description of Artificial Sequence: Synthetic polypeptide
  1A7[CD28]_H1.25
EVQLLESGGGLVQPGGSLRLSCAASGFTFSSYAMSWVRQAPGKGLEWVSTIEGSGTSTYYADSVKGRFTISRDNSKNTLYLQMNSLRAEDTAVYYCAKSGPGLRQVGFDYWGQGTLVTVSS

SEQ ID NO: 610 - protein, 121 aa, Artificial Sequence
  Description of Artificial Sequence: Synthetic polypeptide
  1A7[CD28]_H1.26
EVQLLESGGGLVQPGGSLRLSCAASGFTFSSYAMSWVRQAPGKGLEWVSTIEGSGYSTYYADSVKGRFTISRDNSKNTLYLQMNSLRAEDTAVYYCAKSGPGLRQVGFDYWGQGTLVTVSS

SEQ ID NO: 611 - protein, 121 aa, Artificial Sequence
  Description of Artificial Sequence: Synthetic polypeptide
  1A7[CD28]_H1.27
EVQLLESGGGLVQPGGSLRLSCAASGFTFSSYAMSWVRQAPGKGLEWVSTIEGSGDYTYYADSVKGRFTISRDNSKNTLYLQMNSLRAEDTAVYYCAKSGPGLRQVGFDYWGQGTLVTVSS

SEQ ID NO: 612 - protein, 121 aa, Artificial Sequence
  Description of Artificial Sequence: Synthetic polypeptide
  1A7[CD28]_H1.28
EVQLLESGGGLVQPGGSLRLSCAASGFTFSSYAMSWVRQAPGKGLEWVSTIYDSGDSTYYADSVKGRFTISRDNSKNTLYLQMNSLRAEDTAVYYCAKSGPGLRQVGFDYWGQGTLVTVSS

SEQ ID NO: 613 - protein, 121 aa, Artificial Sequence
  Description of Artificial Sequence: Synthetic polypeptide
  1A7[CD28]_H1.29
EVQLLESGGGLVQPGGSLRLSCAASGFTFSSYAMSWVRQAPGKGLEWVSTIYESGDSTYYADSVKGRFTISRDNSKNTLYLQMNSLRAEDTAVYYCAKSGPGLRQVGFDYWGQGTLVTVSS

SEQ ID NO: 614 - protein, 121 aa, Artificial Sequence
  Description of Artificial Sequence: Synthetic polypeptide
  1A7[CD28]_H1.30
EVQLLESGGGLVQPGGSLRLSCAASGFTFSSYAMSWVRQAPGKGLEWVSTIYGSGTSTYYADSVKGRFTISRDNSKNTLYLQMNSLRAEDTAVYYCAKSGPGLRQVGFDYWGQGTLVTVSS

SEQ ID NO: 615 - protein, 121 aa, Artificial Sequence
  Description of Artificial Sequence: Synthetic polypeptide
  1A7[CD28]_H1.31
EVQLLESGGGLVQPGGSLRLSCAASGFTFSSYAMSWVRQAPGKGLEWVSTIYGSGYSTYYADSVKGRFTISRDNSKNTLYLQMNSLRAEDTAVYYCAKSGPGLRQVGFDYWGQGTLVTVSS

SEQ ID NO: 616 - protein, 121 aa, Artificial Sequence
  Description of Artificial Sequence: Synthetic polypeptide
  1A7[CD28]_H1.32
EVQLLESGGGLVQPGGSLRLSCAASGFTFSSYAMSWVRQAPGKGLEWVSTIYGSGDYTYYADSVKGRFTISRDNSKNTLYLQMNSLRAEDTAVYYCAKSGPGLRQVGFDYWGQGTLVTVSS

SEQ ID NO: 617 - protein, 121 aa, Artificial Sequence
  Description of Artificial Sequence: Synthetic polypeptide
  1A7[CD28]_H1.33
EVQLLESGGGLVQPGGSLRLSCAASGFTFSSYAMSWVRQAPGKGLEWVSTISDSGTSTYYADSVKGRFTISRDNSKNTLYLQMNSLRAEDTAVYYCAKSGPGLRQVGFDYWGQGTLVTVSS

SEQ ID NO: 618 - protein, 121 aa, Artificial Sequence
  Description of Artificial Sequence: Synthetic polypeptide
  1A7[CD28]_H1.34
EVQLLESGGGLVQPGGSLRLSCAASGFTFSSYAMSWVRQAPGKGLEWVSTISDSGYSTYYADSVKGRFTISRDNSKNTLYLQMNSLRAEDTAVYYCAKSGPGLRQVGFDYWGQGTLVTVSS

SEQ ID NO: 619 - protein, 121 aa, Artificial Sequence
  Description of Artificial Sequence: Synthetic polypeptide
  1A7[CD28]_H1.35
EVQLLESGGGLVQPGGSLRLSCAASGFTFSSYAMSWVRQAPGKGLEWVSTISDSGDYTYYADSVKGRFTISRDNSKNTLYLQMNSLRAEDTAVYYCAKSGPGLRQVGFDYWGQGTLVTVSS

SEQ ID NO: 620 - protein, 121 aa, Artificial Sequence
  Description of Artificial Sequence: Synthetic polypeptide
  1A7[CD28]_H1.36
EVQLLESGGGLVQPGGSLRLSCAASGFTFSSYAMSWVRQAPGKGLEWVSTISESGTSTYYADSVKGRFTISRDNSKNTLYLQMNSLRAEDTAVYYCAKSGPGLRQVGFDYWGQGTLVTVSS

SEQ ID NO: 621 - protein, 121 aa, Artificial Sequence
  Description of Artificial Sequence: Synthetic polypeptide
  1A7[CD28]_H1.37
EVQLLESGGGLVQPGGSLRLSCAASGFTFSSYAMSWVRQAPGKGLEWVSTISESGYSTYYADSVKGRFTISRDNSKNTLYLQMNSLRAEDTAVYYCAKSGPGLRQVGFDYWGQGTLVTVSS

SEQ ID NO: 622 - protein, 121 aa, Artificial Sequence
  Description of Artificial Sequence: Synthetic polypeptide
  1A7[CD28]_H1.38
EVQLLESGGGLVQPGGSLRLSCAASGFTFSSYAMSWVRQAPGKGLEWVSTISESGDYTYYADSVKGRFTISRDNSKNTLYLQMNSLRAEDTAVYYCAKSGPGLRQVGFDYWGQGTLVTVSS

SEQ ID NO: 623 - protein, 121 aa, Artificial Sequence
  Description of Artificial Sequence: Synthetic polypeptide
  1A7[CD28]_H1.39
EVQLLESGGGLVQPGGSLRLSCAASGFTFSSYAMSWVRQAPGKGLEWVSTISGSGTYTYYADSVKGRFTISRDNSKNTLYLQMNSLRAEDTAVYYCAKSGPGLRQVGFDYWGQGTLVTVSS

SEQ ID NO: 624 - protein, 121 aa, Artificial Sequence
  Description of Artificial Sequence: Synthetic polypeptide
  1A7[CD28]_H1.40
EVQLLESGGGLVQPGGSLRLSCAASGFTFSSYAMSWVRQAPGKGLEWVSTISGSGYYTYYADSVKGRFTISRDNSKNTLYLQMNSLRAEDTAVYYCAKSGPGLRQVGFDYWGQGTLVTVSS

SEQ ID NO: 625 - protein, 121 aa, Artificial Sequence
  Description of Artificial Sequence: Synthetic polypeptide
  1A7[CD28]_H1.43
EVQLLESGGGLVQPGGSLRLSCAASGFSFSGNYMTWVRQAPGKGLEWVATITADSDATYYADSVKGRFTISRDNSKNTLYLQMNSLRAEDTAVYYCAKSGPGLRQVGFDYWGQGTLVTVSS

SEQ ID NO: 626 - protein, 121 aa, Artificial Sequence
  Description of Artificial Sequence: Synthetic polypeptide
  1A7[CD28]_H1.44
EVQLLESGGGLVQPGGSLRLSCAASGFTFSGYSMNWVRQAPGKGLEWVATIYANGSYTYYADSVKGRFTISRDNSKNTLYLQMNSLRAEDTAVYYCAKSGPGLRQVGFDYWGQGTLVTVSS

SEQ ID NO: 627 - protein, 121 aa, Artificial Sequence
  Description of Artificial Sequence: Synthetic polypeptide
  1A7[CD28]_H1.45
EVQLLESGGGLVQPGGSLRLSCAASGFNFEEYSMNWVRQAPGKGLEWVATITYNGDYTYYADSVKGRFTISRDNSKNTLYLQMNSLRAEDTAVYYCAKSGPGLRQVGFDYWGQGTLVTVSS

SEQ ID NO: 628 - protein, 121 aa, Artificial Sequence
  Description of Artificial Sequence: Synthetic polypeptide
  1A7[CD28]_H1.46
EVQLLESGGGLVQPGGSLRLSCAASGFSFRTYYMTWVRQAPGKGLEWVATITSDGDYTYYADSVKGRFTISRDNSKNTLYLQMNSLRAEDTAVYYCAKSGPGLRQVGFDYWGQGTLVTVSS

SEQ ID NO: 629 - protein, 121 aa, Artificial Sequence
  Description of Artificial Sequence: Synthetic polypeptide
  1A7[CD28]_H1.47
EVQLLESGGGLVQPGGSLRLSCAASGFSFKGYSMNWVRQAPGKGLEWVATIYASSDSTYYADSVKGRFTISRDNSKNTLYLQMNSLRAEDTAVYYCAKSGPGLRQVGFDYWGQGTLVTVSS

SEQ ID NO: 630 - protein, 121 aa, Artificial Sequence
  Description of Artificial Sequence: Synthetic polypeptide
  1A7[CD28]_H1.48
EVQLLESGGGLVQPGGSLRLSCAASGFSFGEYSMNWVRQAPGKGLEWVSTIYADGDYTYYADSVKGRFTISRDNSKNTLYLQMNSLRAEDTAVYYCAKSGPGLRQVGFDYWGQGTLVTVSS

SEQ ID NO: 631 - protein, 121 aa, Artificial Sequence
  Description of Artificial Sequence: Synthetic polypeptide
  1A7[CD28]_H1.49
EVQLLESGGGLVQPGGSLRLSCAASGFTFTDYSMNWVRQAPGKGLEWVATIYADSSSTYYADSVKGRFTISRDNSKNTLYLQMNSLRAEDTAVYYCAKSGPGLRQVGFDYWGQGTLVTVSS

SEQ ID NO: 632 - protein, 121 aa, Artificial Sequence
  Description of Artificial Sequence: Synthetic polypeptide
  1A7[CD28]_H1.50
EVQLLESGGGLVQPGGSLRLSCAASGFTFGGYSMNWVRQAPGKGLEWVATIYYDSTTTYYADSVKGRFTISRDNSKNTLYLQMNSLRAEDTAVYYCAKSGPGLRQVGFDYWGQGTLVTVSS

SEQ ID NO: 633 - protein, 121 aa, Artificial Sequence
  Description of Artificial Sequence: Synthetic polypeptide
  1A7[CD28]_H1.51
EVQLLESGGGLVQPGGSLRLSCAASGFTFGAYSMNWVRQAPGKGLEWVSTIYNDGATTYYADSVKGRFTISRDNSKNTLYLQMNSLRAEDTAVYYCAKSGPGLRQVGFDYWGQGTLVTVSS

SEQ ID NO: 634 - protein, 121 aa, Artificial Sequence
  Description of Artificial Sequence: Synthetic polypeptide
  1A7[CD28]_H1.52
EVQLLESGGGLVQPGGSLRLSCAASGFSFEAYSMNWVRQAPGKGLEWVATIYYDSSYTYYADSVKGRFTISRDNSKNTLYLQMNSLRAEDTAVYYCAKSGPGLRQVGFDYWGQGTLVTVSS

SEQ ID NO: 635 - protein, 121 aa, Artificial Sequence
  Description of Artificial Sequence: Synthetic polypeptide
  1A7[CD28]_H1.53
EVQLLESGGGLVQPGGSLRLSCAASGFSFGSYYMSWVRQAPGKGLEWVASIYYGGYDTYYADSVKGRFTISRDNSKNTLYLQMNSLRAEDTAVYYCAKSGPGLRQVGFDYWGQGTLVTVSS

SEQ ID NO: 636 - protein, 121 aa, Artificial Sequence
  Description of Artificial Sequence: Synthetic polypeptide
  1A7[CD28]_H1.54
EVQLLESGGGLVQPGGSLRLSCAASGFNFAEYSMSWVRQAPGKGLEWVATIYAGSDYTYYADSVKGRFTISRDNSKNTLYLQMNSLRAEDTAVYYCAKSGPGLRQVGFDYWGQGTLVTVSS

SEQ ID NO: 637 - protein, 121 aa, Artificial Sequence
  Description of Artificial Sequence: Synthetic polypeptide
  1A7[CD28]_H1.55
EVQLLESGGGLVQPGGSLRLSCAASGFTFGAYSINWVRQAPGKGLEWVATIYYDGSYTYYADSVKGRFTISRDNSKNTLYLQMNSLRAEDTAVYYCAKSGPGLRQVGFDYWGQGTLVTVSS

SEQ ID NO: 638 - protein, 121 aa, Artificial Sequence
  Description of Artificial Sequence: Synthetic polypeptide
  1A7[CD28]_H1.56
EVQLLESGGGLVQPGGSLRLSCAASGFTFSRYYINWVRQAPGKGLEWVASIYDGGADTYYADSVKGRFTISRDNSKNTLYLQMNSLRAEDTAVYYCAKSGPGLRQVGFDYWGQGTLVTVSS

SEQ ID NO: 639 - protein, 121 aa, Artificial Sequence
  Description of Artificial Sequence: Synthetic polypeptide
  1A7[CD28]_H1.57
EVQLLESGGGLVQPGGSLRLSCAASGFSFGTYSINWVRQAPGKGLEWVSTIYYDGASTYYADSVKGRFTISRDNSKNTLYLQMNSLRAEDTAVYYCAKSGPGLRQVGFDYWGQGTLVTVSS

SEQ ID NO: 640 - protein, 121 aa, Artificial Sequence
  Description of Artificial Sequence: Synthetic polypeptide
  1A7[CD28]_H1.58
EVQLLESGGGLVQPGGSLRLSCAASGFTFGKYSISWVRQAPGKGLEWVATIYNDGYYTYYADSVKGRFTISRDNSKNTLYLQMNSLRAEDTAVYYCAKSGPGLRQVGFDYWGQGTLVTVSS

SEQ ID NO: 641 - protein, 121 aa, Artificial Sequence
  Description of Artificial Sequence: Synthetic polypeptide
  1A7[CD28]_H1.59
EVQLLESGGGLVQPGGSLRLSCAASGFSFEKYYISWVRQAPGKGLEWVASIYDGSYDTYYADSVKGRFTISRDNSKNTLYLQMNSLRAEDTAVYYCAKSGPGLRQVGFDYWGQGTLVTVSS

SEQ ID NO: 642 - protein, 121 aa, Artificial Sequence
  Description of Artificial Sequence: Synthetic polypeptide
  1A7[CD28]_H1.60
EVQLLESGGGLVQPGGSLRLSCAASGFSFGTYSMNWVRQAPGKGLEWVATIDYDGSNTYYADSVKGRFTISRDNSKNTLYLQMNSLRAEDTAVYYCAKSGPGLRQVGFDYWGQGTLVTVSS

SEQ ID NO: 643 - protein, 121 aa, Artificial Sequence
  Description of Artificial Sequence: Synthetic polypeptide
  1A7[CD28]_H1.61
EVQLLESGGGLVQPGGSLRLSCAASGFSFAAYSMSWVRQAPGKGLEWVATIYAGSDYTYYADSVKGRFTISRDNSKNTLYLQMNSLRAEDTAVYYCAKSGPGLRQVGFDYWGQGTLVTVSS

SEQ ID NO: 644 - protein, 121 aa, Artificial Sequence
  Description of Artificial Sequence: Synthetic polypeptide
  1A7[CD28]_H1.62
EVQLLESGGGLVQPGGSLRLSCAASGFTFTTYSMTWVRQAPGKGLEWVATIYNDGYYTYYADSVKGRFTISRDNSKNTLYLQMNSLRAEDTAVYYCAKSGPGLRQVGFDYWGQGTLVTVSS

SEQ ID NO: 645 - protein, 121 aa, Artificial Sequence
  Description of Artificial Sequence: Synthetic polypeptide
  1A7[CD28]_H1.63
EVQLLESGGGLVQPGGSLRLSCAASGFSFKDYSMNWVRQAPGKGLEWVATIYYDGTYTYYADSVKGRFTISRDNSKNTLYLQMNSLRAEDTAVYYCAKSGPGLRQVGFDYWGQGTLVTVSS

SEQ ID NO: 646 - protein, 121 aa, Artificial Sequence
  Description of Artificial Sequence: Synthetic polypeptide
  1A7[CD28]_H1.64
EVQLLESGGGLVQPGGSLRLSCAASGFSFAAYSMNWVRQAPGKGLEWVATIYAGGAYTYYADSVKGRFTISRDNSKNTLYLQMNSLRAEDTAVYYCAKSGPGLRQVGFDYWGQGTLVTVSS

SEQ ID NO: 647 - protein, 121 aa, Artificial Sequence
  Description of Artificial Sequence: Synthetic polypeptide
  1A7[CD28]_H1.65
EVQLLESGGGLVQPGGSLRLSCAASGFNFAEYYISWVRQAPGKGLEWVASIYNGGSDTYYADSVKGRFTISRDNSKNTLYLQMNSLRAEDTAVYYCAKSGPGLRQVGFDYWGQGTLVTVSS

SEQ ID NO: 648 - protein, 121 aa, Artificial Sequence
  Description of Artificial Sequence: Synthetic polypeptide
  1A7[CD28]_H1.66
EVQLLESGGGLVQPGGSLRLSCAASGFSLGEYYMNWVRQAPGKGLEWVSTIDYDGTYTYYADSVKGRFTISRDNSKNTLYLQMNSLRAEDTAVYYCAKSGPGLRQVGFDYWGQGTLVTVSS

SEQ ID NO: 649 - protein, 121 aa, Artificial Sequence
  Description of Artificial Sequence: Synthetic polypeptide
  1A7[CD28]_H1.67
EVQLLESGGGLVQPGGSLRLSCAASGFTFNEYYITWVRQAPGKGLEWVSSIYSSSYDTYYADSVKGRFTISRDNSKNTLYLQMNSLRAEDTAVYYCAKSGPGLRQVGFDYWGQGTLVTVSS

SEQ ID NO: 650 - protein, 121 aa, Artificial Sequence
  Description of Artificial Sequence: Synthetic polypeptide
  1A7[CD28]_H1.68
EVQLLESGGGLVQPGGSLRLSCAASGFTFKDYYITWVRQAPGKGLEWVSSIYTSGYDTYYADSVKGRFTISRDNSKNTLYLQMNSLRAEDTAVYYCAKSGPGLRQVGFDYWGQGTLVTVSS

SEQ ID NO: 651 - protein, 121 aa, Artificial Sequence
  Description of Artificial Sequence: Synthetic polypeptide
  1A7[CD28]_H1.69
EVQLLESGGGLVQPGGSLRLSCAASGFSFGKYSINWVRQAPGKGLEWVATIYSDGTDTYYADSVKGRFTISRDNSKNTLYLQMNSLRAEDTAVYYCAKSGPGLRQVGFDYWGQGTLVTVSS

SEQ ID NO: 652 - protein, 107 aa, Artificial Sequence
  Description of Artificial Sequence: Synthetic polypeptide
  1A7[CD28]_L1.1
DIQMTQSPSSLSASVGDRVTITCRASQSISAYLNWYQQKPGKAPKLLIYAASSLQSGVPSRFSGSGSGTDFTLTISSLQPEDFATYYCQQSYSTPFTFGQGTKLEIK

SEQ ID NO: 653 - protein, 107 aa, Artificial Sequence
  Description of Artificial Sequence: Synthetic polypeptide
  1A7[CD28]_L1.2
DIQMTQSPSSLSASVGDRVTITCRASQSISDYLNWYQQKPGKAPKLLIYAASSLQSGVPSRFSGSGSGTDFTLTISSLQPEDFATYYCQQSYSTPFTFGQGTKLEIK

SEQ ID NO: 654 - protein, 107 aa, Artificial Sequence
  Description of Artificial Sequence: Synthetic polypeptide
  1A7[CD28]_L1.3
DIQMTQSPSSLSASVGDRVTITCRASQSISGYLNWYQQKPGKAPKLLIYAASSLQSGVPSRFSGSGSGTDFTLTISSLQPEDFATYYCQQSYSTPFTFGQGTKLEIK

SEQ ID NO: 655 - protein, 107 aa, Artificial Sequence
  Description of Artificial Sequence: Synthetic polypeptide
  1A7[CD28]_L1.4
DIQMTQSPSSLSASVGDRVTITCRASQSISHYLNWYQQKPGKAPKLLIYAASSLQSGVPSRFSGSGSGTDFTLTISSLQPEDFATYYCQQSYSTPFTFGQGTKLEIK

SEQ ID NO: 656 - protein, 107 aa, Artificial Sequence
  Description of Artificial Sequence: Synthetic polypeptide
  1A7[CD28]_L1.5
DIQMTQSPSSLSASVGDRVTITCRASQSISKYLNWYQQKPGKAPKLLIYAASSLQSGVPSRFSGSGSGTDFTLTISSLQPEDFATYYCQQSYSTPFTFGQGTKLEIK

SEQ ID NO: 657 - protein, 107 aa, Artificial Sequence
  Description of Artificial Sequence: Synthetic polypeptide
  1A7[CD28]_L1.6
DIQMTQSPSSLSASVGDRVTITCRASQSISNYLNWYQQKPGKAPKLLIYAASSLQSGVPSRFSGSGSGTDFTLTISSLQPEDFATYYCQQSYSTPFTFGQGTKLEIK

SEQ ID NO: 658 - protein, 107 aa, Artificial Sequence
  Description of Artificial Sequence: Synthetic polypeptide
  1A7[CD28]_L1.7
DIQMTQSPSSLSASVGDRVTITCRASQSISQYLNWYQQKPGKAPKLLIYAASSLQSGVPSRFSGSGSGTDFTLTISSLQPEDFATYYCQQSYSTPFTFGQGTKLEIK

SEQ ID NO: 659 - protein, 107 aa, Artificial Sequence
  Description of Artificial Sequence: Synthetic polypeptide
  1A7[CD28]_L1.8
DIQMTQSPSSLSASVGDRVTITCRASQSISTYLNWYQQKPGKAPKLLIYAASSLQSGVPSRFSGSGSGTDFTLTISSLQPEDFATYYCQQSYSTPFTFGQGTKLEIK

SEQ ID NO: 660 - protein, 107 aa, Artificial Sequence
  Description of Artificial Sequence: Synthetic polypeptide
  1A7[CD28]_L1.9
DIQMTQSPSSLSASVGDRVTITCRASQSISVYLNWYQQKPGKAPKLLIYAASSLQSGVPSRFSGSGSGTDFTLTISSLQPEDFATYYCQQSYSTPFTFGQGTKLEIK

SEQ ID NO: 661 - protein, 107 aa, Artificial Sequence
  Description of Artificial Sequence: Synthetic polypeptide
  1A7[CD28]_L1.10
DIQMTQSPSSLSASVGDRVTITCRASQSISYYLNWYQQKPGKAPKLLIYAASSLQSGVPSRFSGSGSGTDFTLTISSLQPEDFATYYCQQSYSTPFTFGQGTKLEIK

SEQ ID NO: 662 - protein, 107 aa, Artificial Sequence
  Description of Artificial Sequence: Synthetic polypeptide
  1A7[CD28]_L1.11
DIQMTQSPSSLSASVGDRVTITCRASQSISSALNWYQQKPGKAPKLLIYAASSLQSGVPSRFSGSGSGTDFTLTISSLQPEDFATYYCQQSYSTPFTFGQGTKLEIK

SEQ ID NO: 663 - protein, 107 aa, Artificial Sequence
  Description of Artificial Sequence: Synthetic polypeptide
  1A7[CD28]_L1.12
DIQMTQSPSSLSASVGDRVTITCRASQSISSDLNWYQQKPGKAPKLLIYAASSLQSGVPSRFSGSGSGTDFTLTISSLQPEDFATYYCQQSYSTPFTFGQGTKLEIK

SEQ ID NO: 664 - protein, 107 aa, Artificial Sequence
  Description of Artificial Sequence: Synthetic polypeptide
  1A7[CD28]_L1.13
DIQMTQSPSSLSASVGDRVTITCRASQSISSFLNWYQQKPGKAPKLLIYAASSLQSGVPSRFSGSGSGTDFTLTISSLQPEDFATYYCQQSYSTPFTFGQGTKLEIK

SEQ ID NO: 665 - protein, 107 aa, Artificial Sequence
  Description of Artificial Sequence: Synthetic polypeptide
  1A7[CD28]_L1.14
DIQMTQSPSSLSASVGDRVTITCRASQSISSHLNWYQQKPGKAPKLLIYAASSLQSGVPSRFSGSGSGTDFTLTISSLQPEDFATYYCQQSYSTPFTFGQGTKLEIK

SEQ ID NO: 666 - protein, 107 aa, Artificial Sequence
  Description of Artificial Sequence: Synthetic polypeptide
  1A7[CD28]_L1.15
DIQMTQSPSSLSASVGDRVTITCRASQSISSKLNWYQQKPGKAPKLLIYAASSLQSGVPSRFSGSGSGTDFTLTISSLQPEDFATYYCQQSYSTPFTFGQGTKLEIK

SEQ ID NO: 667 - protein, 107 aa, Artificial Sequence
  Description of Artificial Sequence: Synthetic polypeptide
  1A7[CD28]_L1.16
DIQMTQSPSSLSASVGDRVTITCRASQSISSLLNWYQQKPGKAPKLLIYAASSLQSGVPSRFSGSGSGTDFTLTISSLQPEDFATYYCQQSYSTPFTFGQGTKLEIK

SEQ ID NO: 668 - protein, 107 aa, Artificial Sequence
  Description of Artificial Sequence: Synthetic polypeptide
  1A7[CD28]_L1.17
DIQMTQSPSSLSASVGDRVTITCRASQSISSNLNWYQQKPGKAPKLLIYAASSLQSGVPSRFSGSGSGTDFTLTISSLQPEDFATYYCQQSYSTPFTFGQGTKLEIK

SEQ ID NO: 669 - protein, 107 aa, Artificial Sequence
  Description of Artificial Sequence: Synthetic polypeptide
  1A7[CD28]_L1.18
DIQMTQSPSSLSASVGDRVTITCRASQSISSQLNWYQQKPGKAPKLLIYAASSLQSGVPSRFSGSGSGTDFTLTISSLQPEDFATYYCQQSYSTPFTFGQGTKLEIK

SEQ ID NO: 670 - protein, 107 aa, Artificial Sequence
  Description of Artificial Sequence: Synthetic polypeptide
  1A7[CD28]_L1.19
DIQMTQSPSSLSASVGDRVTITCRASQSISSSLNWYQQKPGKAPKLLIYAASSLQSGVPSRFSGSGSGTDFTLTISSLQPEDFATYYCQQSYSTPFTFGQGTKLEIK

SEQ ID NO: 671 - protein, 107 aa, Artificial Sequence
  Description of Artificial Sequence: Synthetic polypeptide
  1A7[CD28]_L1.20
DIQMTQSPSSLSASVGDRVTITCRASQSISSWLNWYQQKPGKAPKLLIYAASSLQSGVPSRFSGSGSGTDFTLTISSLQPEDFATYYCQQSYSTPFTFGQGTKLEIK

SEQ ID NO: 672 - protein, 107 aa, Artificial Sequence
  Description of Artificial Sequence: Synthetic polypeptide
  1A7[CD28]_L1.21
DIQMTQSPSSLSASVGDRVTITCRASQSISSYLAWYQQKPGKAPKLLIYAASSLQSGVPSRFSGSGSGTDFTLTISSLQPEDFATYYCQQSYSTPFTFGQGTKLEIK

SEQ ID NO: 673 - protein, 107 aa, Artificial Sequence
  Description of Artificial Sequence: Synthetic polypeptide
  1A7[CD28]_L1.22
DIQMTQSPSSLSASVGDRVTITCRASQSISSYLDWYQQKPGKAPKLLIYAASSLQSGVPSRFSGSGSGTDFTLTISSLQPEDFATYYCQQSYSTPFTFGQGTKLEIK

SEQ ID NO: 674 - protein, 107 aa, Artificial Sequence
  Description of Artificial Sequence: Synthetic polypeptide
  1A7[CD28]_L1.23
DIQMTQSPSSLSASVGDRVTITCRASQSISSYLGWYQQKPGKAPKLLIYAASSLQSGVPSRFSGSGSGTDFTLTISSLQPEDFATYYCQQSYSTPFTFGQGTKLEIK

SEQ ID NO: 675 - protein, 107 aa, Artificial Sequence
  Description of Artificial Sequence: Synthetic polypeptide
  1A7[CD28]_L1.24
DIQMTQSPSSLSASVGDRVTITCRASQSISSYLHWYQQKPGKAPKLLIYAASSLQSGVPSRFSGSGSGTDFTLTISSLQPEDFATYYCQQSYSTPFTFGQGTKLEIK

SEQ ID NO: 676 - protein, 107 aa, Artificial Sequence
  Description of Artificial Sequence: Synthetic polypeptide
  1A7[CD28]_L1.25
DIQMTQSPSSLSASVGDRVTITCRASQSISSYLQWYQQKPGKAPKLLIYAASSLQSGVPSRFSGSGSGTDFTLTISSLQPEDFATYYCQQSYSTPFTFGQGTKLEIK

SEQ ID NO: 677 - protein, 107 aa, Artificial Sequence
  Description of Artificial Sequence: Synthetic polypeptide
  1A7[CD28]_L1.26
DIQMTQSPSSLSASVGDRVTITCRASQSISSYLSWYQQKPGKAPKLLIYAASSLQSGVPSRFSGSGSGTDFTLTISSLQPEDFATYYCQQSYSTPFTFGQGTKLEIK

SEQ ID NO: 678 - protein, 107 aa, Artificial Sequence
  Description of Artificial Sequence: Synthetic polypeptide
  1A7[CD28]_L1.27
DIQMTQSPSSLSASVGDRVTITCRASQSISSYLTWYQQKPGKAPKLLIYAASSLQSGVPSRFSGSGSGTDFTLTISSLQPEDFATYYCQQSYSTPFTFGQGTKLEIK

SEQ ID NO: 679 - protein, 107 aa, Artificial Sequence
  Description of Artificial Sequence: Synthetic polypeptide
  1A7[CD28]_L1.28
DIQMTQSPSSLSASVGDRVTITCRASQSISSYLYWYQQKPGKAPKLLIYAASSLQSGVPSRFSGSGSGTDFTLTISSLQPEDFATYYCQQSYSTPFTFGQGTKLEIK

SEQ ID NO: 680 - protein, 107 aa, Artificial Sequence
  Description of Artificial Sequence: Synthetic polypeptide
  1A7[CD28]_L1.29
DIQMTQSPSSLSASVGDRVTITCRASQSISSYLNWYQQKPGKAPKLLIYDASSLQSGVPSRFSGSGSGTDFTLTISSLQPEDFATYYCQQSYSTPFTFGQGTKLEIK

SEQ ID NO: 681 - protein, 107 aa, Artificial Sequence
  Description of Artificial Sequence: Synthetic polypeptide
  1A7[CD28]_L1.30
DIQMTQSPSSLSASVGDRVTITCRASQSISSYLNWYQQKPGKAPKLLIYGASSLQSGVPSRFSGSGSGTDFTLTISSLQPEDFATYYCQQSYSTPFTFGQGTKLEIK

SEQ ID NO: 682 - protein, 107 aa, Artificial Sequence
  Description of Artificial Sequence: Synthetic polypeptide
  1A7[CD28]_L1.31
DIQMTQSPSSLSASVGDRVTITCRASQSISSYLNWYQQKPGKAPKLLIYKASSLQSGVPSRFSGSGSGTDFTLTISSLQPEDFATYYCQQSYSTPFTFGQGTKLEIK

SEQ ID NO: 683 - protein, 107 aa, Artificial Sequence
  Description of Artificial Sequence: Synthetic polypeptide
  1A7[CD28]_L1.32
DIQMTQSPSSLSASVGDRVTITCRASQSISSYLNWYQQKPGKAPKLLIYLASSLQSGVPSRFSGSGSGTDFTLTISSLQPEDFATYYCQQSYSTPFTFGQGTKLEIK

SEQ ID NO: 684 - protein, 107 aa, Artificial Sequence
  Description of Artificial Sequence: Synthetic polypeptide
  1A7[CD28]_L1.33
DIQMTQSPSSLSASVGDRVTITCRASQSISSYLNWYQQKPGKAPKLLIYQASSLQSGVPSRFSGSGSGTDFTLTISSLQPEDFATYYCQQSYSTPFTFGQGTKLEIK

SEQ ID NO: 685 - protein, 107 aa, Artificial Sequence
  Description of Artificial Sequence: Synthetic polypeptide
  1A7[CD28]_L1.34
DIQMTQSPSSLSASVGDRVTITCRASQSISSYLNWYQQKPGKAPKLLIYSASSLQSGVPSRFSGSGSGTDFTLTISSLQPEDFATYYCQQSYSTPFTFGQGTKLEIK

SEQ ID NO: 686 - protein, 107 aa, Artificial Sequence
  Description of Artificial Sequence: Synthetic polypeptide
  1A7[CD28]_L1.35
DIQMTQSPSSLSASVGDRVTITCRASQSISSYLNWYQQKPGKAPKLLIYTASSLQSGVPSRFSGSGSGTDFTLTISSLQPEDFATYYCQQSYSTPFTFGQGTKLEIK

SEQ ID NO: 687 - protein, 107 aa, Artificial Sequence
  Description of Artificial Sequence: Synthetic polypeptide
  1A7[CD28]_L1.36
DIQMTQSPSSLSASVGDRVTITCRASQSISSYLNWYQQKPGKAPKLLIYWASSLQSGVPSRFSGSGSGTDFTLTISSLQPEDFATYYCQQSYSTPFTFGQGTKLEIK

SEQ ID NO: 688 - protein, 107 aa, Artificial Sequence
  Description of Artificial Sequence: Synthetic polypeptide
  1A7[CD28]_L1.37
DIQMTQSPSSLSASVGDRVTITCRASQSISSYLNWYQQKPGKAPKLLIYYASSLQSGVPSRFSGSGSGTDFTLTISSLQPEDFATYYCQQSYSTPFTFGQGTKLEIK

SEQ ID NO: 689 - protein, 107 aa, Artificial Sequence
  Description of Artificial Sequence: Synthetic polypeptide
  1A7[CD28]_L1.38
DIQMTQSPSSLSASVGDRVTITCRASQSISSYLNWYQQKPGKAPKLLIYAASALQSGVPSRFSGSGSGTDFTLTISSLQPEDFATYYCQQSYSTPFTFGQGTKLEIK

SEQ ID NO: 690 - protein, 107 aa, Artificial Sequence
  Description of Artificial Sequence: Synthetic polypeptide
  1A7[CD28]_L1.39
DIQMTQSPSSLSASVGDRVTITCRASQSISSYLNWYQQKPGKAPKLLIYAASDLQSGVPSRFSGSGSGTDFTLTISSLQPEDFATYYCQQSYSTPFTFGQGTKLEIK

SEQ ID NO: 691 - protein, 107 aa, Artificial Sequence
  Description of Artificial Sequence: Synthetic polypeptide
  1A7[CD28]_L1.40
DIQMTQSPSSLSASVGDRVTITCRASQSISSYLNWYQQKPGKAPKLLIYAASKLQSGVPSRFSGSGSGTDFTLTISSLQPEDFATYYCQQSYSTPFTFGQGTKLEIK

SEQ ID NO: 692 - protein, 107 aa, Artificial Sequence
  Description of Artificial Sequence: Synthetic polypeptide
  1A7[CD28]_L1.41
DIQMTQSPSSLSASVGDRVTITCRASQSISSYLNWYQQKPGKAPKLLIYAASNLQSGVPSRFSGSGSGTDFTLTISSLQPEDFATYYCQQSYSTPFTFGQGTKLEIK

SEQ ID NO: 693 - protein, 107 aa, Artificial Sequence
  Description of Artificial Sequence: Synthetic polypeptide
  1A7[CD28]_L1.42
DIQMTQSPSSLSASVGDRVTITCRASQSISSYLNWYQQKPGKAPKLLIYAASQLQSGVPSRFSGSGSGTDFTLTISSLQPEDFATYYCQQSYSTPFTFGQGTKLEIK

SEQ ID NO: 694 - protein, 107 aa, Artificial Sequence
  Description of Artificial Sequence: Synthetic polypeptide
  1A7[CD28]_L1.43
DIQMTQSPSSLSASVGDRVTITCRASQSISSYLNWYQQKPGKAPKLLIYAASTLQSGVPSRFSGSGSGTDFTLTISSLQPEDFATYYCQQSYSTPFTFGQGTKLEIK

SEQ ID NO: 695 - protein, 107 aa, Artificial Sequence
  Description of Artificial Sequence: Synthetic polypeptide
  1A7[CD28]_L1.44
DIQMTQSPSSLSASVGDRVTITCRASQSISSYLNWYQQKPGKAPKLLIYAASYLQSGVPSRFSGSGSGTDFTLTISSLQPEDFATYYCQQSYSTPFTFGQGTKLEIK

SEQ ID NO: 696 - protein, 107 aa, Artificial Sequence
  Description of Artificial Sequence: Synthetic polypeptide
  1A7[CD28]_L1.45
DIQMTQSPSSLSASVGDRVTITCRASQSISSYLNWYQQKPGKAPKLLIYAASSLASGVPSRFSGSGSGTDFTLTISSLQPEDFATYYCQQSYSTPFTFGQGTKLEIK

SEQ ID NO: 697 - protein, 107 aa, Artificial Sequence
  Description of Artificial Sequence: Synthetic polypeptide
  1A7[CD28]_L1.46
DIQMTQSPSSLSASVGDRVTITCRASQSISSYLNWYQQKPGKAPKLLIYAASSLESGVPSRFSGSGSGTDFTLTISSLQPEDFATYYCQQSYSTPFTFGQGTKLEIK

SEQ ID NO: 698 - protein, 107 aa, Artificial Sequence
  Description of Artificial Sequence: Synthetic polypeptide
  1A7[CD28]_L1.47
DIQMTQSPSSLSASVGDRVTITCRASQSISSYLNWYQQKPGKAPKLLIYAASSLFSGVPSRFSGSGSGTDFTLTISSLQPEDFATYYCQQSYSTPFTFGQGTKLEIK

SEQ ID NO: 699 - protein, 107 aa, Artificial Sequence
  Description of Artificial Sequence: Synthetic polypeptide
  1A7[CD28]_L1.48
DIQMTQSPSSLSASVGDRVTITCRASQSISSYLNWYQQKPGKAPKLLIYAASSLHSGVPSRFSGSGSGTDFTLTISSLQPEDFATYYCQQSYSTPFTFGQGTKLEIK

SEQ ID NO: 700 - protein, 107 aa, Artificial Sequence
  Description of Artificial Sequence: Synthetic polypeptide
  1A7[CD28]_L1.49
DIQMTQSPSSLSASVGDRVTITCRASQSISSYLNWYQQKPGKAPKLLIYAASSLISGVPSRFSGSGSGTDFTLTISSLQPEDFATYYCQQSYSTPFTFGQGTKLEIK

SEQ ID NO: 701 - protein, 107 aa, Artificial Sequence
  Description of Artificial Sequence: Synthetic polypeptide
  1A7[CD28]_L1.50
DIQMTQSPSSLSASVGDRVTITCRASQSISSYLNWYQQKPGKAPKLLIYAASSLKSGVPSRFSGSGSGTDFTLTISSLQPEDFATYYCQQSYSTPFTFGQGTKLEIK

SEQ ID NO: 702 - protein, 107 aa, Artificial Sequence
  Description of Artificial Sequence: Synthetic polypeptide
  1A7[CD28]_L1.51
DIQMTQSPSSLSASVGDRVTITCRASQSISSYLNWYQQKPGKAPKLLIYAASSLNSGVPSRFSGSGSGTDFTLTISSLQPEDFATYYCQQSYSTPFTFGQGTKLEIK

SEQ ID NO: 703 - protein, 107 aa, Artificial Sequence
  Description of Artificial Sequence: Synthetic polypeptide
  1A7[CD28]_L1.52
DIQMTQSPSSLSASVGDRVTITCRASQSISSYLNWYQQKPGKAPKLLIYAASSLSSGVPSRFSGSGSGTDFTLTISSLQPEDFATYYCQQSYSTPFTFGQGTKLEIK

SEQ ID NO: 704 - protein, 107 aa, Artificial Sequence
  Description of Artificial Sequence: Synthetic polypeptide
  1A7[CD28]_L1.53
DIQMTQSPSSLSASVGDRVTITCRASQSISSYLNWYQQKPGKAPKLLIYAASSLVSGVPSRFSGSGSGTDFTLTISSLQPEDFATYYCQQSYSTPFTFGQGTKLEIK

SEQ ID NO: 705 - protein, 107 aa, Artificial Sequence
  Description of Artificial Sequence: Synthetic polypeptide
  1A7[CD28]_L1.54
DIQMTQSPSSLSASVGDRVTITCRASQSISSYLNWYQQKPGKAPKLLIYAASSLYSGVPSRFSGSGSGTDFTLTISSLQPEDFATYYCQQSYSTPFTFGQGTKLEIK

SEQ ID NO: 706 - protein, 107 aa, Artificial Sequence
  Description of Artificial Sequence: Synthetic polypeptide
  1A7[CD28]_L1.55
DIQMTQSPSSLSASVGDRVTITCRASQSISSYLNWYQQKPGKAPKLLIYAASSLQAGVPSRFSGSGSGTDFTLTISSLQPEDFATYYCQQSYSTPFTFGQGTKLEIK

SEQ ID NO: 707 - protein, 107 aa, Artificial Sequence
  Description of Artificial Sequence: Synthetic polypeptide
  1A7[CD28]_L1.56
DIQMTQSPSSLSASVGDRVTITCRASQSISSYLNWYQQKPGKAPKLLIYAASSLQDGVPSRFSGSGSGTDFTLTISSLQPEDFATYYCQQSYSTPFTFGQGTKLEIK

SEQ ID NO: 708 - protein, 107 aa, Artificial Sequence
  Description of Artificial Sequence: Synthetic polypeptide
  1A7[CD28]_L1.57
DIQMTQSPSSLSASVGDRVTITCRASQSISSYLNWYQQKPGKAPKLLIYAASSLQGGVPSRFSGSGSGTDFTLTISSLQPEDFATYYCQQSYSTPFTFGQGTKLEIK

SEQ ID NO: 709 - protein, 107 aa, Artificial Sequence
  Description of Artificial Sequence: Synthetic polypeptide
  1A7[CD28]_L1.58
DIQMTQSPSSLSASVGDRVTITCRASQSISSYLNWYQQKPGKAPKLLIYAASSLQHGVPSRFSGSGSGTDFTLTISSLQPEDFATYYCQQSYSTPFTFGQGTKLEIK

SEQ ID NO: 710 - protein, 107 aa, Artificial Sequence
  Description of Artificial Sequence: Synthetic polypeptide
  1A7[CD28]_L1.59
DIQMTQSPSSLSASVGDRVTITCRASQSISSYLNWYQQKPGKAPKLLIYAASSLQKGVPSRFSGSGSGTDFTLTISSLQPEDFATYYCQQSYSTPFTFGQGTKLEIK

SEQ ID NO: 711 - protein, 107 aa, Artificial Sequence
  Description of Artificial Sequence: Synthetic polypeptide
  1A7[CD28]_L1.60
DIQMTQSPSSLSASVGDRVTITCRASQSISSYLNWYQQKPGKAPKLLIYAASSLQQGVPSRFSGSGSGTDFTLTISSLQPEDFATYYCQQSYSTPFTFGQGTKLEIK

SEQ ID NO: 712 - protein, 107 aa, Artificial Sequence
  Description of Artificial Sequence: Synthetic polypeptide
  1A7[CD28]_L1.61
DIQMTQSPSSLSASVGDRVTITCRASQSISSYLNWYQQKPGKAPKLLIYAASSLQTGVPSRFSGSGSGTDFTLTISSLQPEDFATYYCQQSYSTPFTFGQGTKLEIK

SEQ ID NO: 713 - protein, 107 aa, Artificial Sequence
  Description of Artificial Sequence: Synthetic polypeptide
  1A7[CD28]_L1.62
DIQMTQSPSSLSASVGDRVTITCRASQSISSYLNWYQQKPGKAPKLLIYAASSLQVGVPSRFSGSGSGTDFTLTISSLQPEDFATYYCQQSYSTPFTFGQGTKLEIK

SEQ ID NO: 714 - protein, 107 aa, Artificial Sequence
  Description of Artificial Sequence: Synthetic polypeptide
  1A7[CD28]_L1.63
DIQMTQSPSSLSASVGDRVTITCRASQSISSYLNWYQQKPGKAPKLLIYAASSLQYGVPSRFSGSGSGTDFTLTISSLQPEDFATYYCQQSYSTPFTFGQGTKLEIK

SEQ ID NO: 715 - protein, 107 aa, Artificial Sequence
  Description of Artificial Sequence: Synthetic polypeptide
  1A7[CD28]_L1.64
DIQMTQSPSSLSASVGDRVTITCRASQSISSYLNWYQQKPGKAPKLLIYAASSLQSGVPSRFSGSGSGTDFTLTISSLQPEDFATYYCQQAYSTPFTFGQGTKLEIK

SEQ ID NO: 716 - protein, 107 aa, Artificial Sequence
  Description of Artificial Sequence: Synthetic polypeptide
  1A7[CD28]_L1.65
DIQMTQSPSSLSASVGDRVTITCRASQSISSYLNWYQQKPGKAPKLLIYAASSLQSGVPSRFSGSGSGTDFTLTISSLQPEDFATYYCQQDYSTPFTFGQGTKLEIK

SEQ ID NO: 717 - protein, 107 aa, Artificial Sequence
  Description of Artificial Sequence: Synthetic polypeptide
  1A7[CD28]_L1.66
DIQMTQSPSSLSASVGDRVTITCRASQSISSYLNWYQQKPGKAPKLLIYAASSLQSGVPSRFSGSGSGTDFTLTISSLQPEDFATYYCQQFYSTPFTFGQGTKLEIK

SEQ ID NO: 718 - protein, 107 aa, Artificial Sequence
  Description of Artificial Sequence: Synthetic polypeptide
  1A7[CD28]_L1.67
DIQMTQSPSSLSASVGDRVTITCRASQSISSYLNWYQQKPGKAPKLLIYAASSLQSGVPSRFSGSGSGTDFTLTISSLQPEDFATYYCQQHYSTPFTFGQGTKLEIK

SEQ ID NO: 719 - protein, 107 aa, Artificial Sequence
  Description of Artificial Sequence: Synthetic polypeptide
  1A7[CD28]_L1.68
DIQMTQSPSSLSASVGDRVTITCRASQSISSYLNWYQQKPGKAPKLLIYAASSLQSGVPSRFSGSGSGTDFTLTISSLQPEDFATYYCQQKYSTPFTFGQGTKLEIK

SEQ ID NO: 720 - protein, 107 aa, Artificial Sequence
  Description of Artificial Sequence: Synthetic polypeptide
  1A7[CD28]_L1.69
DIQMTQSPSSLSASVGDRVTITCRASQSISSYLNWYQQKPGKAPKLLIYAASSLQSGVPSRFSGSGSGTDFTLTISSLQPEDFATYYCQQLYSTPFTFGQGTKLEIK

SEQ ID NO: 721 - protein, 107 aa, Artificial Sequence
  Description of Artificial Sequence: Synthetic polypeptide
  1A7[CD28]_L1.70
DIQMTQSPSSLSASVGDRVTITCRASQSISSYLNWYQQKPGKAPKLLIYAASSLQSGVPSRFSGSGSGTDFTLTISSLQPEDFATYYCQQTYSTPFTFGQGTKLEIK

SEQ ID NO: 722 - protein, 107 aa, Artificial Sequence
  Description of Artificial Sequence: Synthetic polypeptide
  1A7[CD28]_L1.71
DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK

SEQ ID NO: 723 - protein, 107 aa, Artificial Sequence
  Description of Artificial Sequence: Synthetic polypeptide
  1A7[CD28]_L1.72
DIQMTQSPSSLSASVGDRVTITCRASQSISSYLNWYQQKPGKAPKLLIYAASSLQSGVPSRFSGSGSGTDFTLTISSLQPEDFATYYCQQYYSTPFTFGQGTKLEIK

SEQ ID NO: 724 - protein, 107 aa, Artificial Sequence
  Description of Artificial Sequence: Synthetic polypeptide
  1A7[CD28]_L1.73
DIQMTQSPSSLSASVGDRVTITCRASQSISSYLNWYQQKPGKAPKLLIYAASSLQSGVPSRFSGSGSGTDFTLTISSLQPEDFATYYCQQSASTPFTFGQGTKLEIK

SEQ ID NO: 725 - protein, 107 aa, Artificial Sequence
  Description of Artificial Sequence: Synthetic polypeptide
  1A7[CD28]_L1.74
DIQMTQSPSSLSASVGDRVTITCRASQSISSYLNWYQQKPGKAPKLLIYAASSLQSGVPSRFSGSGSGTDFTLTISSLQPEDFATYYCQQSDSTPFTFGQGTKLEIK

SEQ ID NO: 726 - protein, 107 aa, Artificial Sequence
  Description of Artificial Sequence: Synthetic polypeptide
  1A7[CD28]_L1.75
DIQMTQSPSSLSASVGDRVTITCRASQSISSYLNWYQQKPGKAPKLLIYAASSLQSGVPSRFSGSGSGTDFTLTISSLQPEDFATYYCQQSFSTPFTFGQGTKLEIK

SEQ ID NO: 727 - protein, 107 aa, Artificial Sequence
  Description of Artificial Sequence: Synthetic polypeptide
  1A7[CD28]_L1.76
DIQMTQSPSSLSASVGDRVTITCRASQSISSYLNWYQQKPGKAPKLLIYAASSLQSGVPSRFSGSGSGTDFTLTISSLQPEDFATYYCQQSHSTPFTFGQGTKLEIK

SEQ ID NO: 728 - protein, 107 aa, Artificial Sequence
  Description of Artificial Sequence: Synthetic polypeptide
  1A7[CD28]_L1.77
DIQMTQSPSSLSASVGDRVTITCRASQSISSYLNWYQQKPGKAPKLLIYAASSLQSGVPSRFSGSGSGTDFTLTISSLQPEDFATYYCQQSKSTPFTFGQGTKLEIK

SEQ ID NO: 729 - protein, 107 aa, Artificial Sequence
  Description of Artificial Sequence: Synthetic polypeptide
  1A7[CD28]_L1.78
DIQMTQSPSSLSASVGDRVTITCRASQSISSYLNWYQQKPGKAPKLLIYAASSLQSGVPSRFSGSGSGTDFTLTISSLQPEDFATYYCQQSLSTPFTFGQGTKLEIK

SEQ ID NO: 730 - protein, 107 aa, Artificial Sequence
  Description of Artificial Sequence: Synthetic polypeptide
  1A7[CD28]_L1.79
DIQMTQSPSSLSASVGDRVTITCRASQSISSYLNWYQQKPGKAPKLLIYAASSLQSGVPSRFSGSGSGTDFTLTISSLQPEDFATYYCQQSQSTPFTFGQGTKLEIK

SEQ ID NO: 731 - protein, 107 aa, Artificial Sequence
  Description of Artificial Sequence: Synthetic polypeptide
  1A7[CD28]_L1.80
DIQMTQSPSSLSASVGDRVTITCRASQSISSYLNWYQQKPGKAPKLLIYAASSLQSGVPSRFSGSGSGTDFTLTISSLQPEDFATYYCQQSVSTPFTFGQGTKLEIK

SEQ ID NO: 732 - protein, 107 aa, Artificial Sequence
  Description of Artificial Sequence: Synthetic polypeptide
  1A7[CD28]_L1.81
DIQMTQSPSSLSASVGDRVTITCRASQSISSYLNWYQQKPGKAPKLLIYAASSLQSGVPSRFSGSGSGTDFTLTISSLQPEDFATYYCQQSWSTPFTFGQGTKLEIK

SEQ ID NO: 733 - protein, 107 aa, Artificial Sequence
  Description of Artificial Sequence: Synthetic polypeptide
  1A7[CD28]_L1.82
DIQMTQSPSSLSASVGDRVTITCRASQSISSYLNWYQQKPGKAPKLLIYAASSLQSGVPSRFSGSGSGTDFTLTISSLQPEDFATYYCQQSYATPFTFGQGTKLEIK

SEQ ID NO: 734 - protein, 107 aa, Artificial Sequence
  Description of Artificial Sequence: Synthetic polypeptide
  1A7[CD28]_L1.83
DIQMTQSPSSLSASVGDRVTITCRASQSISSYLNWYQQKPGKAPKLLIYAASSLQSGVPSRFSGSGSGTDFTLTISSLQPEDFATYYCQQSYDTPFTFGQGTKLEIK

SEQ ID NO: 735 - protein, 107 aa, Artificial Sequence
  Description of Artificial Sequence: Synthetic polypeptide
  1A7[CD28]_L1.84
DIQMTQSPSSLSASVGDRVTITCRASQSISSYLNWYQQKPGKAPKLLIYAASSLQSGVPSRFSGSGSGTDFTLTISSLQPEDFATYYCQQSYGTPFTFGQGTKLEIK

SEQ ID NO: 736 - protein, 107 aa, Artificial Sequence
  Description of Artificial Sequence: Synthetic polypeptide
  1A7[CD28]_L1.85
DIQMTQSPSSLSASVGDRVTITCRASQSISSYLNWYQQKPGKAPKLLIYAASSLQSGVPSRFSGSGSGTDFTLTISSLQPEDFATYYCQQSYHTPFTFGQGTKLEIK

SEQ ID NO: 737 - protein, 107 aa, Artificial Sequence
  Description of Artificial Sequence: Synthetic polypeptide
  1A7[CD28]_L1.86
DIQMTQSPSSLSASVGDRVTITCRASQSISSYLNWYQQKPGKAPKLLIYAASSLQSGVPSRFSGSGSGTDFTLTISSLQPEDFATYYCQQSYKTPFTFGQGTKLEIK

SEQ ID NO: 738 - protein, 107 aa, Artificial Sequence
  Description of Artificial Sequence: Synthetic polypeptide
  1A7[CD28]_L1.87
DIQMTQSPSSLSASVGDRVTITCRASQSISSYLNWYQQKPGKAPKLLIYAASSLQSGVPSRFSGSGSGTDFTLTISSLQPEDFATYYCQQSYNTPFTFGQGTKLEIK

SEQ ID NO: 739 - protein, 107 aa, Artificial Sequence
  Description of Artificial Sequence: Synthetic polypeptide
  1A7[CD28]_L1.88
DIQMTQSPSSLSASVGDRVTITCRASQSISSYLNWYQQKPGKAPKLLIYAASSLQSGVPSRFSGSGSGTDFTLTISSLQPEDFATYYCQQSYQTPFTFGQGTKLEIK

SEQ ID NO: 740 - protein, 107 aa, Artificial Sequence
  Description of Artificial Sequence: Synthetic polypeptide
  1A7[CD28]_L1.89
DIQMTQSPSSLSASVGDRVTITCRASQSISSYLNWYQQKPGKAPKLLIYAASSLQSGVPSRFSGSGSGTDFTLTISSLQPEDFATYYCQQSYTTPFTFGQGTKLEIK

SEQ ID NO: 741 - protein, 107 aa, Artificial Sequence
  Description of Artificial Sequence: Synthetic polypeptide
  1A7[CD28]_L1.90
DIQMTQSPSSLSASVGDRVTITCRASQSISSYLNWYQQKPGKAPKLLIYAASSLQSGVPSRFSGSGSGTDFTLTISSLQPEDFATYYCQQSYVTPFTFGQGTKLEIK

SEQ ID NO: 742 - protein, 107 aa, Artificial Sequence
  Description of Artificial Sequence: Synthetic polypeptide
  1A7[CD28]_L1.91
DIQMTQSPSSLSASVGDRVTITCRASQSISSYLNWYQQKPGKAPKLLIYAASSLQSGVPSRFSGSGSGTDFTLTISSLQPEDFATYYCQQSYYTPFTFGQGTKLEIK

SEQ ID NO: 743 - protein, 107 aa, Artificial Sequence
  Description of Artificial Sequence: Synthetic polypeptide
  1A7[CD28]_L1.92
DIQMTQSPSSLSASVGDRVTITCRASQSISSYLNWYQQKPGKAPKLLIYAASSLQSGVPSRFSGSGSGTDFTLTISSLQPEDFATYYCQQSYSAPFTFGQGTKLEIK

SEQ ID NO: 744 - protein, 107 aa, Artificial Sequence
  Description of Artificial Sequence: Synthetic polypeptide
  1A7[CD28]_L1.93
DIQMTQSPSSLSASVGDRVTITCRASQSISSYLNWYQQKPGKAPKLLIYAASSLQSGVPSRFSGSGSGTDFTLTISSLQPEDFATYYCQQSYSDPFTFGQGTKLEIK

SEQ ID NO: 745 - protein, 107 aa, Artificial Sequence
  Description of Artificial Sequence: Synthetic polypeptide
  1A7[CD28]_L1.94
DIQMTQSPSSLSASVGDRVTITCRASQSISSYLNWYQQKPGKAPKLLIYAASSLQSGVPSRFSGSGSGTDFTLTISSLQPEDFATYYCQQSYSFPFTFGQGTKLEIK

SEQ ID NO: 746 - protein, 107 aa, Artificial Sequence
  Description of Artificial Sequence: Synthetic polypeptide
  1A7[CD28]_L1.95
DIQMTQSPSSLSASVGDRVTITCRASQSISSYLNWYQQKPGKAPKLLIYAASSLQSGVPSRFSGSGSGTDFTLTISSLQPEDFATYYCQQSYSIPFTFGQGTKLEIK

SEQ ID NO: 747 - protein, 107 aa, Artificial Sequence
  Description of Artificial Sequence: Synthetic polypeptide
  1A7[CD28]_L1.96
DIQMTQSPSSLSASVGDRVTITCRASQSISSYLNWYQQKPGKAPKLLIYAASSLQSGVPSRFSGSGSGTDFTLTISSLQPEDFATYYCQQSYSKPFTFGQGTKLEIK

SEQ ID NO: 748 - protein, 107 aa, Artificial Sequence
  Description of Artificial Sequence: Synthetic polypeptide
  1A7[CD28]_L1.97
DIQMTQSPSSLSASVGDRVTITCRASQSISSYLNWYQQKPGKAPKLLIYAASSLQSGVPSRFSGSGSGTDFTLTISSLQPEDFATYYCQQSYSLPFTFGQGTKLEIK

SEQ ID NO: 749 - protein, 107 aa, Artificial Sequence
  Description of Artificial Sequence: Synthetic polypeptide
  1A7[CD28]_L1.98
DIQMTQSPSSLSASVGDRVTITCRASQSISSYLNWYQQKPGKAPKLLIYAASSLQSGVPSRFSGSGSGTDFTLTISSLQPEDFATYYCQQSYSQPFTFGQGTKLEIK

SEQ ID NO: 750 - protein, 107 aa, Artificial Sequence
  Description of Artificial Sequence: Synthetic polypeptide
  1A7[CD28]_L1.99
DIQMTQSPSSLSASVGDRVTITCRASQSISSYLNWYQQKPGKAPKLLIYAASSLQSGVPSRFSGSGSGTDFTLTISSLQPEDFATYYCQQSYSSPFTFGQGTKLEIK

SEQ ID NO: 751 - protein, 107 aa, Artificial Sequence
  Description of Artificial Sequence: Synthetic polypeptide
  1A7[CD28]_L1.100
DIQMTQSPSSLSASVGDRVTITCRASQSISSYLNWYQQKPGKAPKLLIYAASSLQSGVPSRFSGSGSGTDFTLTISSLQPEDFATYYCQQSYSVPFTFGQGTKLEIK

SEQ ID NO: 752 - protein, 107 aa, Artificial Sequence
  Description of Artificial Sequence: Synthetic polypeptide
  1A7[CD28]_L1.101
DIQMTQSPSSLSASVGDRVTITCRASQSISSYLNWYQQKPGKAPKLLIYAASSLQSGVPSRFSGSGSGTDFTLTISSLQPEDFATYYCQQSYSYPFTFGQGTKLEIK

SEQ ID NO: 753 - protein, 107 aa, Artificial Sequence
  Description of Artificial Sequence: Synthetic polypeptide
  1A7[CD28]_L1.102
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTKLEIK

SEQ ID NO: 754 - protein, 107 aa, Artificial Sequence
  Description of Artificial Sequence: Synthetic polypeptide
  1A7[CD28]_L1.103
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKLEIK

SEQ ID NO: 755 - protein, 107 aa, Artificial Sequence
  Description of Artificial Sequence: Synthetic polypeptide
  1A7[CD28]_L1.104
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 756 - protein, 107 aa, Artificial Sequence
  Description of Artificial Sequence: Synthetic polypeptide
  1A7[CD28]_L1.106
DIQMTQSPSSLSASVGDRVTITCRASQSISSYLTWYQQKPGKAPKLLIYAASSLQSGVPSRFSGSGSGTDFTLTISSLQPEDFATYYCQQSYNTPFTFGQGTKLEIK

SEQ ID NO: 757 - protein, 220 aa, Homo sapiens
  sp|P10747|CD28_HUMAN T-cell-specific surface glycoprotein CD28 OS=Homo sapiens OX=9606 GN=CD28 PE=1 SV=1 Human CD28 sequence
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 758 - protein, 134 aa, Homo sapiens
  sp|P10747|19-152 Human CD28, extracellular domain
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 759 - protein, 218 aa, Mus musculus
  sp|P31041|CD28_MOUSE T-cell-specific surface glycoprotein CD28 OS=Mus musculus OX=10090 GN=Cd28 PE=1 SV=2 Mouse CD28 sequence
MTLRLLFLALNFFSVQVTENKILVKQSPLLVVDSNEVSLSCRYSYNLLAKEFRASLYKGVNSDVEVCVGNGNFTYQPQFRSNAEFNCDGDFDNETVTFRLWNLHVNHTDIYFCKIEFMYPPPYLDNERSNGTIIHIKEKHLCHTQSSPKLFWALVVVAGVLFCYGLLVTVALCVIWTNSRRNRLLQSDYMNMTPRRPGLTRKPYQPYAPARDFAAYRP

SEQ ID NO: 760 - protein, 131 aa, Mus musculus
  sp|P31041|20-150 Mouse CD28, extracellular domain
NKILVKQSPLLVVDSNEVSLSCRYSYNLLAKEFRASLYKGVNSDVEVCVGNGNFTYQPQFRSNAEFNCDGDFDNETVTFRLWNLHVNHTDIYFCKIEFMYPPPYLDNERSNGTIIHIKEKHLCHTQSSPKL

SEQ ID NO: 761 - protein, 220 aa, Macaca fascicularis
  tr|Q0PDN3|Q0PDN3_MACFA CD28 OS=Macaca fascicularis OX=9541 GN=CD28 PE=2 SV=1 Cynomolgus CD28 sequence
MLRLLLALNLLPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWALVVVGGVLACYSLLVTVAFCIFWMRSKRSRLLHSDYMNMTPRRPGPTRKHYQPYAPPRDFAAYRS

SEQ ID NO: 762 - protein, 134 aa, Macaca fascicularis; identical to SEQ ID NO: 758
  tr|Q0PDN3|19-152 Cynomolgus CD28, extracellular domain

SEQ ID NO: 763 - protein, 534 aa, Homo sapiens
  sp|Q5ZPR3|CD276_HUMAN CD276 antigen OS=Homo sapiens OX=9606 GN=CD276 PE=1 SV=1 Human B7H3 sequence
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 764 - protein, 439 aa, Homo sapiens
  sp|Q5ZPR3|29-466 Human B7H3, extracellular domain
LEVQVPEDPVVALVGTDATSLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 765 - protein, 111 aa, Homo sapiens
  Human B7H3, V1C1 domain
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVA

SEQ ID NO: 766 - protein, 214 aa, Homo sapiens
  Human B7H3, V2C2 domain
PTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTIT

SEQ ID NO: 767 - protein, 316 aa, Mus musculus
  sp|Q8VE98|CD276_MOUSE CD276 antigen OS=Mus musculus OX=10090 GN=Cd276 PE=1 SV=1 Mouse B7H3 sequence
MLRGWGGPSVGVCVRTALGVLCLCLTGAVEVQVSEDPVVALVDTDATLRCSFSPEPGFSLAQLNLIWQLTDTKQLVHSFTEGRDQGSAYSNRTALFPDLLVQGNASLRLQRVRVTDEGSYTCFVSIQDFDSAAVSLQVAAPYSKPSMTLEPNKDLRPGNMVTITCSSYQGYPEAEVFWKDGQGVPLTGNVTTSQMANERGLFDVHSVLRVVLGANGTYSCLVRNPVLQQDAHGSVTITGQPLTFPPEALWVTVGLSVCLVVLLVALAFVCWRKIKQSCEEENAGAEDQDGDGEGSKTALRPLKPSENKEDDGQEIA

SEQ ID NO: 768 - protein, 220 aa, Mus musculus
  sp|Q8VE98|29-248 Mouse B7H3, extracellular domain
VEVQVSEDPVVALVDTDATLRCSFSPEPGFSLAQLNLIWQLTDTKQLVHSFTEGRDQGSAYSNRTALFPDLLVQGNASLRLQRVRVTDEGSYTCFVSIQDFDSAAVSLQVAAPYSKPSMTLEPNKDLRPGNMVTITCSSYQGYPEAEVFWKDGQGVPLTGNVTTSQMANERGLFDVHSVLRVVLGANGTYSCLVRNPVLQQDAHGSVTITGQPLTFPPEA

SEQ ID NO: 769 - protein, 584 aa, Macaca fascicularis
  XP_015308533.1 PREDICTED:  CD276 antigen isoform X1 [Macaca fascicularis] Cynomolgus CD28 sequence (predicted)
MKLSSDHVFPLFRKLQWLPAAFRIQFTPVSPSAGAAFHHGEPSCQLPHSKMLHRRGSPGMGVHVGAALGALWFCLTGALEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSITITPQRSPTGAVEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSVTITGQPMTFPPEALWVTVGLSVCLVALLVALAFVCWRKIKQSCEEENAGAEDQDGEGEGSKTALQPLKHSDSKEDDGQELA

SEQ ID NO: 770 - protein, 438 aa, Macaca fascicularis
  XP_015308533.1|79-516 Cynomolgus CD28, extracellular domain
LEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSITITPQRSPTGAVEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSVTITGQPMTFPPEA

SEQ ID NO: 771 - protein, 15 aa, Artificial Sequence
  Description of Artificial Sequence: Synthetic peptide
GGGGSGGGGSGGGGS

SEQ ID NO: 772 - protein, 18 aa, Artificial Sequence
  Description of Artificial Sequence: Synthetic peptide
GSTSGSGKPGSGEGSTKG

SEQ ID NO: 773 - protein, 14 aa, Artificial Sequence
  Description of Artificial Sequence: Synthetic peptide
IRPRAIGGSKPRVA

SEQ ID NO: 774 - protein, 15 aa, Artificial Sequence
  Description of Artificial Sequence: Synthetic peptide
GKGGSGKGGSGKGGS

SEQ ID NO: 775 - protein, 15 aa, Artificial Sequence
  Description of Artificial Sequence: Synthetic peptide
GGKGSGGKGSGGKGS

SEQ ID NO: 776 - protein, 15 aa, Artificial Sequence
  Description of Artificial Sequence: Synthetic peptide
GGGKSGGGKSGGGKS

SEQ ID NO: 777 - protein, 15 aa, Artificial Sequence
  Description of Artificial Sequence: Synthetic peptide
GKGKSGKGKSGKGKS

SEQ ID NO: 778 - protein, 15 aa, Artificial Sequence
  Description of Artificial Sequence: Synthetic peptide
GGGKSGGKGSGKGGS

SEQ ID NO: 779 - protein, 15 aa, Artificial Sequence
  Description of Artificial Sequence: Synthetic peptide
GKPGSGKPGSGKPGS

SEQ ID NO: 780 - protein, 20 aa, Artificial Sequence
  Description of Artificial Sequence: Synthetic peptide
GKPGSGKPGSGKPGSGKPGS

SEQ ID NO: 781 - protein, 20 aa, Artificial Sequence
  Description of Artificial Sequence: Synthetic peptide
GKGKSGKGKSGKGKSGKGKS

SEQ ID NO: 782 - protein, 20 aa, Artificial Sequence
  Description of Artificial Sequence: Synthetic peptide
GGGGSGGGGSGGGGSGGGGS

SEQ ID NO: 783 - protein, 14 aa, Artificial Sequence
  Description of Artificial Sequence: Synthetic peptide
STAGDTHLGGEDFD

SEQ ID NO: 784 - protein, 15 aa, Artificial Sequence
  Description of Artificial Sequence: Synthetic peptide
GEGGSGEGGSGEGGS

SEQ ID NO: 785 - protein, 15 aa, Artificial Sequence
  Description of Artificial Sequence: Synthetic peptide
GGEGSGGEGSGGEGS

SEQ ID NO: 786 - protein, 15 aa, Artificial Sequence
  Description of Artificial Sequence: Synthetic peptide
GGGESGGGESGGGES

SEQ ID NO: 787 - protein, 15 aa, Artificial Sequence
  Description of Artificial Sequence: Synthetic peptide
GEGESGEGESGEGES

SEQ ID NO: 788 - protein, 15 aa, Artificial Sequence
  Description of Artificial Sequence: Synthetic peptide
GGGESGGEGSGEGGS

SEQ ID NO: 789 - protein, 20 aa, Artificial Sequence
  Description of Artificial Sequence: Synthetic peptide
GEGESGEGESGEGESGEGES

SEQ ID NO: 790 - protein, 15 aa, Artificial Sequence
  Description of Artificial Sequence: Synthetic peptide
GGGGSGGGGSGGGGS

SEQ ID NO: 791 - protein, 20 aa, Artificial Sequence
  Description of Artificial Sequence: Synthetic peptide
GGGGSGGGGSGGGGSGGGGS

SEQ ID NO: 792 - protein, 18 aa, Artificial Sequence
  Description of Artificial Sequence: Synthetic peptide
GSTSGSGKPGSGEGSTKG

SEQ ID NO: 793 - protein, 19 aa, Artificial Sequence
  Description of Artificial Sequence: Synthetic peptide
PRGASKSGSASQTGSAPGS

SEQ ID NO: 794 - protein, 19 aa, Artificial Sequence
  Description of Artificial Sequence: Synthetic peptide
GTAAAGAGAAGGAAAGAAG

SEQ ID NO: 795 - protein, 19 aa, Artificial Sequence
  Description of Artificial Sequence: Synthetic peptide
GTSGSSGSGSGGSGSGGGG

SEQ ID NO: 796 - protein, 20 aa, Artificial Sequence
  Description of Artificial Sequence: Synthetic peptide
GKPGSGKPGSGKPGSGKPGS

SEQ ID NO: 797 - protein, 5 aa, Artificial Sequence
  Description of Artificial Sequence: Synthetic peptide
GGGGS

SEQ ID NO: 798 - protein, 10 aa, Artificial Sequence
  Description of Artificial Sequence: Synthetic peptide
GGGGSGGGGS

SEQ ID NO: 799 - protein, 15 aa, Artificial Sequence
  Description of Artificial Sequence: Synthetic peptide
GGGGSGGGGSGGGGS

SEQ ID NO: 800 - protein, 20 aa, Artificial Sequence
  Description of Artificial Sequence: Synthetic peptide
GGGGSGGGGSGGGGSGGGGS

SEQ ID NO: 801 - protein, 25 aa, Artificial Sequence
  Description of Artificial Sequence: Synthetic peptide
GGGGSGGGGSGGGGSGGGGSGGGGS

SEQ ID NO: 802 - protein, 30 aa, Artificial Sequence
  Description of Artificial Sequence: Synthetic polypeptide
GGGGSGGGGSGGGGSGGGGSGGGGSGGGGS

SEQ ID NO: 803 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 804 - protein, 5 aa, Artificial Sequence
  Description of Artificial Sequence: Synthetic peptide
GGGGA

SEQ ID NO: 805 - protein, 10 aa, Artificial Sequence
  Description of Artificial Sequence: Synthetic peptide
GGGGAGGGGA

SEQ ID NO: 806 - protein, 15 aa, Artificial Sequence
  Description of Artificial Sequence: Synthetic peptide
GGGGAGGGGAGGGGA

SEQ ID NO: 807 - protein, 20 aa, Artificial Sequence
  Description of Artificial Sequence: Synthetic peptide
GGGGAGGGGAGGGGAGGGGA

SEQ ID NO: 808 - protein, 25 aa, Artificial Sequence
  Description of Artificial Sequence: Synthetic peptide
GGGGAGGGGAGGGGAGGGGAGGGGA

SEQ ID NO: 809 - protein, 30 aa, Artificial Sequence
  Description of Artificial Sequence: Synthetic polypeptide
GGGGAGGGGAGGGGAGGGGAGGGGAGGGGA

SEQ ID NO: 810 - protein, 35 aa, Artificial Sequence
  Description of Artificial Sequence: Synthetic polypeptide
GGGGAGGGGAGGGGAGGGGAGGGGAGGGGAGGGGA

SEQ ID NO: 811 - protein, 30 aa, Artificial Sequence
  Description of Artificial Sequence: Synthetic polypeptide
DPALVHQRPAPPGGGGSGGGGSGGGGSGGG

SEQ ID NO: 812 - protein, 5 aa, Artificial Sequence
  Description of Artificial Sequence: Synthetic peptide
GKPGS

SEQ ID NO: 813 - protein, 25 aa, Artificial Sequence
  Description of Artificial Sequence: Synthetic peptide
GKPGSGKPGSGKPGSGKPGSGKPGS

SEQ ID NO: 814 - protein, 30 aa, Artificial Sequence
  Description of Artificial Sequence: Synthetic polypeptide
GKPGSGKPGSGKPGSGKPGSGKPGSGKPGS

SEQ ID NO: 815 - protein, 5 aa, Artificial Sequence
  Description of Artificial Sequence: Synthetic peptide
GGGES

SEQ ID NO: 816 - protein, 9 aa, Artificial Sequence
  Description of Artificial Sequence: Synthetic peptide
KTHTCPPCP

SEQ ID NO: 817 - protein, 15 aa, Artificial Sequence
  Description of Artificial Sequence: Synthetic peptide
EPKSSDKTHTCPPCP

SEQ ID NO: 818 - protein, 19 aa, Artificial Sequence
  Description of Artificial Sequence: Synthetic peptide
GGGGSGGGGSKTHTCPPCP

SEQ ID NO: 819 - protein, 19 aa, Artificial Sequence
  Description of Artificial Sequence: Synthetic peptide
GKPGSGKPGSKTHTCPPCP

SEQ ID NO: 820 - protein, 14 aa, Artificial Sequence
  Description of Artificial Sequence: Synthetic peptide
GKPGSKTHTCPPCP

SEQ ID NO: 821 - protein, 5 aa, Artificial Sequence
  Description of Artificial Sequence: Synthetic peptide
EPKSC

SEQ ID NO: 822 - protein, 15 aa, Artificial Sequence
  Description of Artificial Sequence: Synthetic peptide
EPKSCGGGGSGGGGS

SEQ ID NO: 823 - protein, 216 aa, Artificial Sequence
  Description of Artificial Sequence: Synthetic polypeptide
  Heterodimeric Fc Backbone 1 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 824 - protein, 216 aa, Artificial Sequence
  Description of Artificial Sequence: Synthetic polypeptide
  Heterodimeric Fc Backbone 1 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 825 - protein, 216 aa, Artificial Sequence; identical to SEQ ID NO: 823
  Description of Artificial Sequence: Synthetic polypeptide
  Heterodimeric Fc Backbone 2 monomer 1 (-)

SEQ ID NO: 826 - protein, 216 aa, Artificial Sequence
  Description of Artificial Sequence: Synthetic polypeptide
  Heterodimeric Fc Backbone monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 827 - protein, 216 aa, Artificial Sequence
  Description of Artificial Sequence: Synthetic polypeptide
  Heterodimeric Fc Backbone 3 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 828 - protein, 216 aa, Artificial Sequence; identical to SEQ ID NO: 826
  Description of Artificial Sequence: Synthetic polypeptide
  Heterodimeric Fc Backbone 3 monomer 2 (+)

SEQ ID NO: 829 - protein, 216 aa, Artificial Sequence
  Description of Artificial Sequence: Synthetic polypeptide
  Heterodimeric Fc Backbone 4 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 830 - protein, 216 aa, Artificial Sequence
  Description of Artificial Sequence: Synthetic polypeptide
  Heterodimeric Fc Backbone 4 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 831 - protein, 216 aa, Artificial Sequence
  Description of Artificial Sequence: Synthetic polypeptide
  Heterodimeric Fc Backbone 5 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 832 - protein, 216 aa, Artificial Sequence
  Description of Artificial Sequence: Synthetic polypeptide
  Heterodimeric Fc Backbone 5 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 833 - protein, 216 aa, Artificial Sequence
  Description of Artificial Sequence: Synthetic polypeptide
  Heterodimeric Fc Backbone 6 monomer 1 (-)
APPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 834 - protein, 216 aa, Artificial Sequence
  Description of Artificial Sequence: Synthetic polypeptide
  Heterodimeric Fc Backbone 6 monomer 2 (+)
APPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 835 - protein, 216 aa, Artificial Sequence
  Description of Artificial Sequence: Synthetic polypeptide
  Heterodimeric Fc Backbone 7 monomer 1 (-)
APPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 836 - protein, 216 aa, Artificial Sequence
  Description of Artificial Sequence: Synthetic polypeptide
  Heterodimeric Fc Backbone 7 monomer 2 (+)
APPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 837 - protein, 217 aa, Artificial Sequence
  Description of Artificial Sequence: Synthetic polypeptide
  Heterodimeric Fc Backbone 8 monomer 1 (-)
APEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 838 - protein, 217 aa, Artificial Sequence
  Description of Artificial Sequence: Synthetic polypeptide
  Heterodimeric Fc Backbone 8 monomer 2 (+)
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 839 - protein, 216 aa, Artificial Sequence
  Description of Artificial Sequence: Synthetic polypeptide
  Heterodimeric Fc Backbone 9 monomer 1 (-)
APPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 840 - protein, 216 aa, Artificial Sequence
  Description of Artificial Sequence: Synthetic polypeptide
  Heterodimeric Fc Backbone 9 monomer 2 (+)
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 841 - protein, 216 aa, Artificial Sequence
  Description of Artificial Sequence: Synthetic polypeptide
  Heterodimeric Fc Backbone 10 monomer 1 (-)
APPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 842 - protein, 216 aa, Artificial Sequence
  Description of Artificial Sequence: Synthetic polypeptide
  Heterodimeric Fc Backbone 10 monomer 2 (+)
APPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 843 - protein, 216 aa, Artificial Sequence
  Description of Artificial Sequence: Synthetic polypeptide
  Heterodimeric Fc Backbone 11 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 844 - protein, 216 aa, Artificial Sequence
  Description of Artificial Sequence: Synthetic polypeptide
  Heterodimeric Fc Backbone 11 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 845 - protein, 216 aa, Artificial Sequence
  Description of Artificial Sequence: Synthetic polypeptide
  Heterodimeric Fc Backbone 12 monomer 1 (-)
APPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 846 - protein, 216 aa, Artificial Sequence; identical to SEQ ID NO: 823
  Description of Artificial Sequence: Synthetic polypeptide
  Heterodimeric Fc Backbone 12 monomer 2 (+)

SEQ ID NO: 847 - protein, 215 aa, Artificial Sequence
  Description of Artificial Sequence: Synthetic polypeptide
  2 + 1 mAb-scFv Heterodimeric Fc Backbone monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPK

SEQ ID NO: 848 - protein, 214 aa, Artificial Sequence
  Description of Artificial Sequence: Synthetic polypeptide
  2 + 1 mAb-scFv Heterodimeric Fc Backbone monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSP

SEQ ID NO: 849 - protein, 113 aa, Artificial Sequence
  Description of Artificial Sequence: Synthetic polypeptide
  IgG1 CH1(+) + hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 850 - protein, 113 aa, Artificial Sequence
  Description of Artificial Sequence: Synthetic polypeptide
  IgG1 CH1(-) + hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCP

SEQ ID NO: 851 - protein, 110 aa, Artificial Sequence
  Description of Artificial Sequence: Synthetic polypeptide
  IgG2 CH1(+) + hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCP

SEQ ID NO: 852 - protein, 110 aa, Artificial Sequence
  Description of Artificial Sequence: Synthetic polypeptide
  IgG2 CH1(-) + hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCP

SEQ ID NO: 853 - protein, 110 aa, Artificial Sequence
  Description of Artificial Sequence: Synthetic polypeptide
  IgG4 CH1(+) + hinge
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCP

SEQ ID NO: 854 - protein, 110 aa, Artificial Sequence
  Description of Artificial Sequence: Synthetic polypeptide
  IgG4 CH1(-) + hinge
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPSCP

SEQ ID NO: 855 - protein, 103 aa, Artificial Sequence
  Description of Artificial Sequence: Synthetic polypeptide
  IgG1 CH1(+) + half hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 856 - protein, 103 aa, Artificial Sequence
  Description of Artificial Sequence: Synthetic polypeptide
  IgG1 CH1(-) + half hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSC

SEQ ID NO: 857 - protein, 98 aa, Artificial Sequence
  Description of Artificial Sequence: Synthetic polypeptide
  IgG1 CH1(+)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 858 - protein, 98 aa, Artificial Sequence
  Description of Artificial Sequence: Synthetic polypeptide
  IgG1 CH1(-)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV

SEQ ID NO: 859 - protein, 98 aa, Artificial Sequence
  Description of Artificial Sequence: Synthetic polypeptide
  IgG2 CH1(+)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 860 - protein, 98 aa, Artificial Sequence
  Description of Artificial Sequence: Synthetic polypeptide
  IgG2 CH1(-)
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTV

SEQ ID NO: 861 - protein, 98 aa, Artificial Sequence
  Description of Artificial Sequence: Synthetic polypeptide
  IgG4 CH1(+)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 862 - protein, 98 aa, Artificial Sequence
  Description of Artificial Sequence: Synthetic polypeptide
  IgG4 CH1(-)
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRV

SEQ ID NO: 863 - protein, 15 aa, Artificial Sequence
  Description of Artificial Sequence: Synthetic peptide
  IgG1 hinge
EPKSCDKTHTCPPCP

SEQ ID NO: 864 - protein, 12 aa, Artificial Sequence
  Description of Artificial Sequence: Synthetic peptide
  IgG2 hinge
ERKCCVECPPCP

SEQ ID NO: 865 - protein, 12 aa, Artificial Sequence
  Description of Artificial Sequence: Synthetic peptide
  IgG4 hinge
ESKYGPPCPSCP

SEQ ID NO: 866 - protein, 107 aa, Artificial Sequence [sequence omitted]

SEQ ID NO: 867 - protein, 106 aa, Artificial Sequence
  Description of Artificial Sequence: Synthetic polypeptide
  Light Chain Constant Domain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 868 - protein, 442 aa, Artificial Sequence
  Description of Artificial Sequence: Synthetic polypeptide
  XENP16432 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 869 - protein, 214 aa, Artificial Sequence
  Description of Artificial Sequence: Synthetic polypeptide
  XENP16432 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 870 - protein, 121 aa, Artificial Sequence
  Description of Artificial Sequence: Synthetic polypeptide
  1A7[CD28]_H1L1 Variable heavy (vh) domain
EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSS

SEQ ID NO: 871 - protein, 5 aa, Artificial Sequence
  Description of Artificial Sequence: Synthetic peptide
  1A7[CD28]_H1L1 vhCDR1
SYAMS

SEQ ID NO: 872 - protein, 17 aa, Artificial Sequence
  Description of Artificial Sequence: Synthetic peptide
  1A7[CD28]_H1L1 vhCDR2
TISGSGDSTYYADSVKG

SEQ ID NO: 873 - protein, 12 aa, Artificial Sequence
  Description of Artificial Sequence: Synthetic peptide
  1A7[CD28]_H1L1 vhCDR3
SGPGLRQVGFDY

SEQ ID NO: 874 - protein, 107 aa, Artificial Sequence
  Description of Artificial Sequence: Synthetic polypeptide
  1A7[CD28]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 875 - protein, 11 aa, Artificial Sequence
  Description of Artificial Sequence: Synthetic peptide
  1A7[CD28]_H1L1 vlCDR1
RASQSISSYLN

SEQ ID NO: 876 - protein, 7 aa, Artificial Sequence
  Description of Artificial Sequence: Synthetic peptide
  1A7[CD28]_H1L1 vlCDR2
AASSLQS

SEQ ID NO: 877 - protein, 9 aa, Artificial Sequence
  Description of Artificial Sequence: Synthetic peptide
  1A7[CD28]_H1L1 vlCDR3
QQSYSTPFT

SEQ ID NO: 878 - protein, 450 aa, Artificial Sequence
  Description of Artificial Sequence: Synthetic polypeptide
  XENP28428 Heavy Chain
EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 879 - protein, 214 aa, Artificial Sequence
  Description of Artificial Sequence: Synthetic polypeptide
  XENP28428 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 880 - protein, 121 aa, Artificial Sequence; identical to SEQ ID NO: 585
  Description of Artificial Sequence: Synthetic polypeptide
  Variable heavy (vh) domain 1A7_H1.1

SEQ ID NO: 881 - protein, 5 aa, Artificial Sequence
  Description of Artificial Sequence: Synthetic peptide
  vhCDR1
SYYMS

SEQ ID NO: 882 - protein, 17 aa, Artificial Sequence
  Description of Artificial Sequence: Synthetic peptide
  vhCDR2
TISGSGDSTYYADSVKG

SEQ ID NO: 883 - protein, 12 aa, Artificial Sequence
  Description of Artificial Sequence: Synthetic peptide
  vhCDR3
SGPGLRQVGFDY

SEQ ID NO: 884 - protein, 121 aa, Artificial Sequence; identical to SEQ ID NO: 598
  Description of Artificial Sequence: Synthetic polypeptide
  Variable heavy (vh) domain 1A7_H1.14

SEQ ID NO: 885 - protein, 5 aa, Artificial Sequence
  Description of Artificial Sequence: Synthetic peptide
  vhCDR1
SYYMS

SEQ ID NO: 886 - protein, 17 aa, Artificial Sequence
  Description of Artificial Sequence: Synthetic peptide
  vhCDR2
TISESGDSTYYADSVKG

SEQ ID NO: 887 - protein, 12 aa, Artificial Sequence
  Description of Artificial Sequence: Synthetic peptide
  vhCDR3
SGPGLRQVGFDY

SEQ ID NO: 888 - protein, 107 aa, Artificial Sequence; identical to SEQ ID NO: 722
  Description of Artificial Sequence: Synthetic polypeptide
  Variable heavy (vh) domain 1A7_L1.71

SEQ ID NO: 889 - protein, 11 aa, Artificial Sequence
  Description of Artificial Sequence: Synthetic peptide
  vhCDR1
RASQSISSYLN

SEQ ID NO: 890 - protein, 7 aa, Artificial Sequence
  Description of Artificial Sequence: Synthetic peptide
  vhCDR2
AASSLQS

SEQ ID NO: 891 - protein, 9 aa, Artificial Sequence
  Description of Artificial Sequence: Synthetic peptide
  vhCDR3
QQVYSTPFT

SEQ ID NO: 892 - protein, 121 aa, Artificial Sequence; identical to SEQ ID NO: 870
  Description of Artificial Sequence: Synthetic polypeptide
  1A7[CD28]_H1_L1.71 Variable Heavy (vh) Domain

SEQ ID NO: 893 - protein, 5 aa, Artificial Sequence
  Description of Artificial Sequence: Synthetic peptide
  1A7[CD28]_H1_L1.71 vhCDR1
SYAMS

SEQ ID NO: 894 - protein, 17 aa, Artificial Sequence
  Description of Artificial Sequence: Synthetic peptide
  1A7[CD28]_H1_L1.71 vhCDR2
TISGSGDSTYYADSVKG

SEQ ID NO: 895 - protein, 12 aa, Artificial Sequence
  Description of Artificial Sequence: Synthetic peptide
  1A7[CD28]_H1_L1.71 vhCDR3
SGPGLRQVGFDY

SEQ ID NO: 896 - protein, 107 aa, Artificial Sequence; identical to SEQ ID NO: 722
  Description of Artificial Sequence: Synthetic polypeptide
  1A7[CD28]_H1_L1.71 Variable Light (vl) Domain

SEQ ID NO: 897 - protein, 11 aa, Artificial Sequence
  Description of Artificial Sequence: Synthetic peptide
  1A7[CD28]_H1_L1.71 vlCDR1
RASQSISSYLN

SEQ ID NO: 898 - protein, 7 aa, Artificial Sequence
  Description of Artificial Sequence: Synthetic peptide
  1A7[CD28]_H1_L1.71 vlCDR2
AASSLQS

SEQ ID NO: 899 - protein, 9 aa, Artificial Sequence
  Description of Artificial Sequence: Synthetic peptide
  1A7[CD28]_H1_L1.71 vlCDR3
QQVYSTPFT

SEQ ID NO: 900 - protein, 121 aa, Artificial Sequence; identical to SEQ ID NO: 585
  Description of Artificial Sequence: Synthetic polypeptide
  1A7[CD28]_H1.1_L1.71 Variable Heavy (vh) Domain

SEQ ID NO: 901 - protein, 5 aa, Artificial Sequence
  Description of Artificial Sequence: Synthetic peptide
  1A7[CD28]_H1.1_L1.71 vhCDR1
SYYMS

SEQ ID NO: 902 - protein, 17 aa, Artificial Sequence
  Description of Artificial Sequence: Synthetic peptide
  1A7[CD28]_H1.1_L1.71 vhCDR2
TISGSGDSTYYADSVKG

SEQ ID NO: 903 - protein, 12 aa, Artificial Sequence
  Description of Artificial Sequence: Synthetic peptide
  1A7[CD28]_H1.1_L1.71 vhCDR3
SGPGLRQVGFDY

SEQ ID NO: 904 - protein, 107 aa, Artificial Sequence; identical to SEQ ID NO: 722
  Description of Artificial Sequence: Synthetic polypeptide
  1A7[CD28]_H1.1_L1.71 Variable Light (vl) Domain

SEQ ID NO: 905 - protein, 11 aa, Artificial Sequence
  Description of Artificial Sequence: Synthetic peptide
  1A7[CD28]_H1.1_L1.71 vlCDR1
RASQSISSYLN

SEQ ID NO: 906 - protein, 7 aa, Artificial Sequence
  Description of Artificial Sequence: Synthetic peptide
  1A7[CD28]_H1.1_L1.71 vlCDR2
AASSLQS

SEQ ID NO: 907 - protein, 9 aa, Artificial Sequence
  Description of Artificial Sequence: Synthetic peptide
  1A7[CD28]_H1.1_L1.71 vlCDR3
QQVYSTPFT

SEQ ID NO: 908 - protein, 121 aa, Artificial Sequence; identical to SEQ ID NO: 598
  Description of Artificial Sequence: Synthetic polypeptide
  1A7[CD28]_H1.14_L1 Variable Heavy (vh) Domain

SEQ ID NO: 909 - protein, 5 aa, Artificial Sequence
  Description of Artificial Sequence: Synthetic peptide
  1A7[CD28]_H1.14_L1 vhCDR1
SYYMS

SEQ ID NO: 910 - protein, 17 aa, Artificial Sequence
  Description of Artificial Sequence: Synthetic peptide
  1A7[CD28]_H1.14_L1 vhCDR2
TISESGDSTYYADSVKG

SEQ ID NO: 911 - protein, 12 aa, Artificial Sequence
  Description of Artificial Sequence: Synthetic peptide
  1A7[CD28]_H1.14_L1 vhCDR3
SGPGLRQVGFDY

SEQ ID NO: 912 - protein, 107 aa, Artificial Sequence; identical to SEQ ID NO: 874
  Description of Artificial Sequence: Synthetic polypeptide
  1A7[CD28]_H1.14_L1 Variable Light (vl) Domain

SEQ ID NO: 913 - protein, 11 aa, Artificial Sequence
  Description of Artificial Sequence: Synthetic peptide
  1A7[CD28]_H1.14_L1 vlCDR1
RASQSISSYLN

SEQ ID NO: 914 - protein, 7 aa, Artificial Sequence
  Description of Artificial Sequence: Synthetic peptide
  1A7[CD28]_H1.14_L1 vlCDR2
AASSLQS

SEQ ID NO: 915 - protein, 9 aa, Artificial Sequence
  Description of Artificial Sequence: Synthetic peptide
  1A7[CD28]_H1.14_L1 vlCDR3
QQSYSTPFT

SEQ ID NO: 916 - protein, 121 aa, Artificial Sequence; identical to SEQ ID NO: 598
  Description of Artificial Sequence: Synthetic polypeptide
  1A7[CD28]_H1.14_L1.71 Variable Heavy (vh) Domain

SEQ ID NO: 917 - protein, 5 aa, Artificial Sequence
  Description of Artificial Sequence: Synthetic peptide
  1A7[CD28]_H1.14_L1.71 vhCDR1
SYYMS

SEQ ID NO: 918 - protein, 17 aa, Artificial Sequence
  Description of Artificial Sequence: Synthetic peptide
  1A7[CD28]_H1.14_L1.71 vhCDR2
TISESGDSTYYADSVKG

SEQ ID NO: 919 - protein, 12 aa, Artificial Sequence
  Description of Artificial Sequence: Synthetic peptide
  1A7[CD28]_H1.14_L1.71 vhCDR3
SGPGLRQVGFDY

SEQ ID NO: 920 - protein, 107 aa, Artificial Sequence; identical to SEQ ID NO: 722
  Description of Artificial Sequence: Synthetic polypeptide
  1A7[CD28]_H1.14_L1.71 Variable Light (vl) Domain

SEQ ID NO: 921 - protein, 11 aa, Artificial Sequence
  Description of Artificial Sequence: Synthetic peptide
  1A7[CD28]_H1.14_L1.71 vlCDR1
RASQSISSYLN

SEQ ID NO: 922 - protein, 7 aa, Artificial Sequence
  Description of Artificial Sequence: Synthetic peptide
  1A7[CD28]_H1.14_L1.71 vlCDR2
AASSLQS

SEQ ID NO: 923 - protein, 9 aa, Artificial Sequence
  Description of Artificial Sequence: Synthetic peptide
  1A7[CD28]_H1.14_L1.71 vlCDR3
QQVYSTPFT

SEQ ID NO: 924 - protein, 450 aa, Artificial Sequence
  Description of Artificial Sequence: Synthetic polypeptide
  XENP27181 Heavy Chain
QVQLQESGPGLVKPSETLSLTCAVSGFSLTSYGVHWIRQPPGKGLEWLGVIWPGGGTNFNSALMSRLTISEDTSKNQVSLKLSSVTAADTAVYYCARDRAYGNYLYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 925 - protein, 218 aa, Artificial Sequence
  Description of Artificial Sequence: Synthetic polypeptide
  XENP27181 Light Chain
DIQMTQSPSSLSASVGDRVTITCRASESVEYYVTSLMQWYQQKPGKAPKLLIYAASNVDSGVPSRFSGSGSGTDFTLTISSLQPEDIATYYCQQSRKVPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 926 - protein, 231 aa, Artificial Sequence
  Description of Artificial Sequence: Synthetic polypeptide
  XENP27656 Chain 1 - empty-Fc(216)_IgG1_pI(-)_Isosteric_A_ C220S/PVA_/S267K/L368D/K370S empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 927 - protein, 483 aa, Artificial Sequence
  Description of Artificial Sequence: Synthetic polypeptide
  XENP27656 Chain 2 - HuTN228[CD28]_H1L1_scFv(GKPGS)4-Fc(216)_IgG1 _C220S/PVA_/S267K/S364K/E357Q scFv-Fc Heavy Chain
QVQLQESGPGLVKPSETLSLTCAVSGFSLTSYGVHWIRQPPGKGLEWLGVIWPGGGTNFNSALMSRLTISEDTSKNQVSLKLSSVTAADTAVYYCARDRAYGNYLYAMDYWGQGTLVTVSSGKPGSGKPGSGKPGSGKPGSDIQMTQSPSSLSASVGDRVTITCRASESVEYYVTSLMQWYQQKPGKAPKLLIYAASNVDSGVPSRFSGSGSGTDFTLTISSLQPEDIATYYCQQSRKVPFTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 928 - protein, 119 aa, Artificial Sequence
  Description of Artificial Sequence: Synthetic polypeptide
  2E4A3.189[B7H3]_H1L1 Variable heavy (vh) domain
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 929 - protein, 5 aa, Artificial Sequence
  Description of Artificial Sequence: Synthetic peptide
  2E4A3.189[B7H3]_H1L1 vhCDR1
NYYMH

SEQ ID NO: 930 - protein, 17 aa, Artificial Sequence
  Description of Artificial Sequence: Synthetic peptide
  2E4A3.189[B7H3]_H1L1 vhCDR2
IISPSAGTTSYAQKFQG

SEQ ID NO: 931 - protein, 10 aa, Artificial Sequence
  Description of Artificial Sequence: Synthetic peptide
  2E4A3.189[B7H3]_H1L1 vhCDR3
GGGSSPRLDY

SEQ ID NO: 932 - protein, 107 aa, Artificial Sequence
  Description of Artificial Sequence: Synthetic polypeptide
  2E4A3.189[B7H3]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 933 - protein, 11 aa, Artificial Sequence
  Description of Artificial Sequence: Synthetic peptide
  2E4A3.189[B7H3]_H1L1 vlCDR1
RASQSISSYLN

SEQ ID NO: 934 - protein, 7 aa, Artificial Sequence
  Description of Artificial Sequence: Synthetic peptide
  2E4A3.189[B7H3]_H1L1 vlCDR2
AASSLQS

SEQ ID NO: 935 - protein, 9 aa, Artificial Sequence
  Description of Artificial Sequence: Synthetic peptide
  2E4A3.189[B7H3]_H1L1 vlCDR3
QQSYSTPYT

SEQ ID NO: 936 - protein, 448 aa, Artificial Sequence
  Description of Artificial Sequence: Synthetic polypeptide
  XENP32637 Heavy Chain
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 937 - protein, 214 aa, Artificial Sequence
  Description of Artificial Sequence: Synthetic polypeptide
  XENP32637 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 938 - protein, 119 aa, Artificial Sequence; identical to SEQ ID NO: 499
  Description of Artificial Sequence: Synthetic polypeptide
  Variable heavy (vh) domain 2E4A3.189_H1.3

SEQ ID NO: 939 - protein, 5 aa, Artificial Sequence
  Description of Artificial Sequence: Synthetic peptide
  vhCDR1
NHYMH

SEQ ID NO: 940 - protein, 17 aa, Artificial Sequence
  Description of Artificial Sequence: Synthetic peptide
  vhCDR2
IISPSAGSTDYAQKFQG

SEQ ID NO: 941 - protein, 10 aa, Artificial Sequence
  Description of Artificial Sequence: Synthetic peptide
  vhCDR3
GGGSSPRLDY

SEQ ID NO: 942 - protein, 119 aa, Artificial Sequence; identical to SEQ ID NO: 518
  Description of Artificial Sequence: Synthetic polypeptide
  Variable heavy (vh) domain 2E4A3.189_H1.22

SEQ ID NO: 943 - protein, 5 aa, Artificial Sequence
  Description of Artificial Sequence: Synthetic peptide
  vhCDR1
NNYMH

SEQ ID NO: 944 - protein, 17 aa, Artificial Sequence
  Description of Artificial Sequence: Synthetic peptide
  vhCDR2
IISPSVGRTAYAQKFQG

SEQ ID NO: 945 - protein, 10 aa, Artificial Sequence
  Description of Artificial Sequence: Synthetic peptide
  vhCDR3
GGGSSPRLDY

SEQ ID NO: 946 - protein, 121 aa, Artificial Sequence
  Description of Artificial Sequence: Synthetic polypeptide
  6A1[B7H3]_H1L1 Variable heavy (vh) domain
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSS

SEQ ID NO: 947 - protein, 5 aa, Artificial Sequence
  Description of Artificial Sequence: Synthetic peptide
  6A1[B7H3]_H1L1 vhCDR1
NYYMA

SEQ ID NO: 948 - protein, 17 aa, Artificial Sequence
  Description of Artificial Sequence: Synthetic peptide
  6A1[B7H3]_H1L1 vhCDR2
SISTGGGSTYYRDSVKG

SEQ ID NO: 949 - protein, 12 aa, Artificial Sequence
  Description of Artificial Sequence: Synthetic peptide
  6A1[B7H3]_H1L1 vhCDR3
DLSAIAATPFAY

SEQ ID NO: 950 - protein, 106 aa, Artificial Sequence
  Description of Artificial Sequence: Synthetic polypeptide
  6A1[B7H3]_H1L1 Variable light (vl) domain
DIQMTQSPSSLSASVGDRVTITCRASQNIYTSLAWYQQKPGKAPKLLIYNAHSLQTGIPSRFSGSGSGADFTLTISSLQPEDFATYFCQQYYSGLTFGSGTKLEIK

SEQ ID NO: 951 - protein, 11 aa, Artificial Sequence
  Description of Artificial Sequence: Synthetic peptide
  6A1[B7H3]_H1L1 vlCDR1
RASQNIYTSLA

SEQ ID NO: 952 - protein, 7 aa, Artificial Sequence
  Description of Artificial Sequence: Synthetic peptide
  6A1[B7H3]_H1L1 vlCDR2
NAHSLQT

SEQ ID NO: 953 - protein, 8 aa, Artificial Sequence
  Description of Artificial Sequence: Synthetic peptide
  6A1[B7H3]_H1L1 vlCDR3
QQYYSGLT

SEQ ID NO: 954 - protein, 450 aa, Artificial Sequence
  Description of Artificial Sequence: Synthetic polypeptide
  XENP33383 Heavy Chain
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 955 - protein, 213 aa, Artificial Sequence
  Description of Artificial Sequence: Synthetic polypeptide
  XENP33383 Light Chain
DIQMTQSPSSLSASVGDRVTITCRASQNIYTSLAWYQQKPGKAPKLLIYNAHSLQTGIPSRFSGSGSGADFTLTISSLQPEDFATYFCQQYYSGLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 956 - protein, 119 aa, Artificial Sequence
  Description of Artificial Sequence: Synthetic polypeptide
  3C4[B7H3]_H1L1.1 Variable heavy (vh) domain
QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSS

SEQ ID NO: 957 - protein, 10 aa, Artificial Sequence
  Description of Artificial Sequence: Synthetic peptide
  3C4[B7H3]_H1L1.1 vhCDR1
GFSLTSYHVS

SEQ ID NO: 958 - protein, 16 aa, Artificial Sequence
  Description of Artificial Sequence: Synthetic peptide
  3C4[B7H3]_H1L1.1 vhCDR2
AISSGGSSYYNSKFQG

SEQ ID NO: 959 - protein, 11 aa, Artificial Sequence
  Description of Artificial Sequence: Synthetic peptide
  3C4[B7H3]_H1L1.1 vhCDR3
DLGAAISWFAY

SEQ ID NO: 960 - protein, 106 aa, Artificial Sequence
  Description of Artificial Sequence: Synthetic polypeptide
  3C4[B7H3]_H1L1.1 Variable light (vl) domain
DIQMTQSPSSLSASVGDRVTITCRTSQSIYKSLAWYQQKPGKAPKLLIYNAHSLQTGIPSRFSGSGSGTDFTLTISSLQPEDFATYFCQQYYSGLTFGSGTKLEIK

SEQ ID NO: 961 - protein, 11 aa, Artificial Sequence
  Description of Artificial Sequence: Synthetic peptide
  3C4[B7H3]_H1L1.1 vlCDR1
RTSQSIYKSLA

SEQ ID NO: 962 - protein, 7 aa, Artificial Sequence
  Description of Artificial Sequence: Synthetic peptide
  3C4[B7H3]_H1L1.1 vlCDR2
NAHSLQT

SEQ ID NO: 963 - protein, 8 aa, Artificial Sequence
  Description of Artificial Sequence: Synthetic peptide
  3C4[B7H3]_H1L1.1 vlCDR3
QQYYSGLT

SEQ ID NO: 964 - protein, 122 aa, Artificial Sequence
  Description of Artificial Sequence: Synthetic polypeptide
  4F12[B7H3]_H2L1.1 Variable heavy (vh) domain
EVQLVESGGGLVKPGGSLRLSCAASGFSFSVGYYMCWVRQAPGKGLEWVSCIYVGSGSSGSTYYASVKGRFTISSDTAKTSVYLQMNSLRAEDTAVYFCARTAGSDWRLDLWGQGTLVTVSS

SEQ ID NO: 965 - protein, 6 aa, Artificial Sequence
  Description of Artificial Sequence: Synthetic peptide
  4F12[B7H3]_H2L1.1 vhCDR1
VGYYMC

SEQ ID NO: 966 - protein, 19 aa, Artificial Sequence
  Description of Artificial Sequence: Synthetic peptide
  4F12[B7H3]_H2L1.1 vhCDR2
CIYVGSGSSGSTYYASVKG

SEQ ID NO: 967 - protein, 10 aa, Artificial Sequence
  Description of Artificial Sequence: Synthetic peptide
  4F12[B7H3]_H2L1.1 vhCDR3
TAGSDWRLDL

SEQ ID NO: 968 - protein, 108 aa, Artificial Sequence
  Description of Artificial Sequence: Synthetic polypeptide
  4F12[B7H3]_H2L1.1 Variable light (vl) domain
DIVMTQSPSSLSASVGDRVTITCRASQSIANELSWYQQKPGKPPKLLIYRASTLTSGVPSRFKGSGSGTDFTLTISSLQPEDFATYYCQSTYNGRAIGFGGGTKVEIK

SEQ ID NO: 969 - protein, 11 aa, Artificial Sequence
  Description of Artificial Sequence: Synthetic peptide
  4F12[B7H3]_H2L1.1 vlCDR1
RASQSIANELS

SEQ ID NO: 970 - protein, 7 aa, Artificial Sequence
  Description of Artificial Sequence: Synthetic peptide
  4F12[B7H3]_H2L1.1 vlCDR2
RASTLTS

SEQ ID NO: 971 - protein, 10 aa, Artificial Sequence
  Description of Artificial Sequence: Synthetic peptide
  4F12[B7H3]_H2L1.1 vlCDR3
QSTYNGRAIG

SEQ ID NO: 972 - protein, 117 aa, Artificial Sequence
  Description of Artificial Sequence: Synthetic polypeptide
  38E2[B7H3]_H2L1.1 Variable heavy (vh) domain
EVQLLESGGGLVQPGGSLRLSCAVSGFSLSSYGVIWVRQAPGKGLEYVSWVSSGGSTNYASSVKGRFTISRDTSKNTVYLQMNSLRAEDTAVYFCARGATNSGTDIWGPGTLVTVSS

SEQ ID NO: 973 - protein, 5 aa, Artificial Sequence
  Description of Artificial Sequence: Synthetic peptide
  38E2[B7H3]_H2L1.1 vhCDR1
SYGVI

SEQ ID NO: 974 - protein, 16 aa, Artificial Sequence
  Description of Artificial Sequence: Synthetic peptide
  38E2[B7H3]_H2L1.1 vhCDR2
WVSSGGSTNYASSVKG

SEQ ID NO: 975 - protein, 9 aa, Artificial Sequence
  Description of Artificial Sequence: Synthetic peptide
  38E2[B7H3]_H2L1.1 vhCDR3
GATNSGTDI

SEQ ID NO: 976 - protein, 110 aa, Artificial Sequence
  Description of Artificial Sequence: Synthetic polypeptide
  38E2[B7H3]_H2L1.1 Variable light (vl) domain
DIVMTQSPSSLSASVGDRVTITCRASQSINSWLSWYQQKPGKPPKLLIYGASNLASGVPSRFKGSGSGTDFTLTISSLQPEDFATYYCQNNYGIIAAGATFGGGTKVEIK

SEQ ID NO: 977 - protein, 11 aa, Artificial Sequence
  Description of Artificial Sequence: Synthetic peptide
  38E2[B7H3]_H2L1.1 vlCDR1
RASQSINSWLS

SEQ ID NO: 978 - protein, 7 aa, Artificial Sequence
  Description of Artificial Sequence: Synthetic peptide
  38E2[B7H3]_H2L1.1 vlCDR2
GASNLAS

SEQ ID NO: 979 - protein, 12 aa, Artificial Sequence
  Description of Artificial Sequence: Synthetic peptide
  38E2[B7H3]_H2L1.1 vlCDR3
QNNYGIIAAGAT

SEQ ID NO: 980 - protein, 448 aa, Artificial Sequence
  Description of Artificial Sequence: Synthetic polypeptide
  XENP34730 Chain 1 - 2E4A3.189[B7H3]_H1.22_Fab_IgG1_pI(-)_ Isosteric_A_/PVA_/S267K/L368D/K370S
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 981 - protein, 479 aa, Artificial Sequence
  Description of Artificial Sequence: Synthetic polypeptide
  XENP34730 Chain 2 - 1A7[CD28]_H1.14_L1_scFv(GKPGS)4_Fc(216)_ IgG1_C220S/PVA_/S267K/S364K/E357Q
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 982 - protein, 214 aa, Artificial Sequence; identical to SEQ ID NO: 937
  Description of Artificial Sequence: Synthetic polypeptide
  XENP34730 Chain 3 - 2E4A3.189[B7H3]_L1 Light Chain

SEQ ID NO: 983 - protein, 450 aa, Artificial Sequence
  Description of Artificial Sequence: Synthetic polypeptide
  XENP34732 Chain 1 - 6A1[B7H3]_H1L1_Fab-IgG1_pI(-)_Isosteric_A _/PVA_/S267K/L368D/K370S/M428L/N434S
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 984 - protein, 479 aa, Artificial Sequence
  Description of Artificial Sequence: Synthetic polypeptide
  XENP34732 Chain 2 - 1A7[CD28]_H1.14_L1_scFv(GKPGS)4-Fc(216)_IgG1 _C220S/PVA_/S267K/S364K/E357Q/M428L/N434S
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 985 - protein, 213 aa, Artificial Sequence; identical to SEQ ID NO: 955
  Description of Artificial Sequence: Synthetic polypeptide
  XENP34732 Chain 3 - 6A1[B7H3]_L1

SEQ ID NO: 986 - protein, 451 aa, Artificial Sequence
  Description of Artificial Sequence: Synthetic polypeptide
  XENP35151 Chain 1 - 4F12[B7H3]_H2_L1.1_Fab-IgG1_pI(-)_Isosteric _A_/PVA_/S267K/L368D/K370S/M428L/N434S
EVQLVESGGGLVKPGGSLRLSCAASGFSFSVGYYMCWVRQAPGKGLEWVSCIYVGSGSSGSTYYASVKGRFTISSDTAKTSVYLQMNSLRAEDTAVYFCARTAGSDWRLDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 987 - protein, 479 aa, Artificial Sequence; identical to SEQ ID NO: 984
  Description of Artificial Sequence: Synthetic polypeptide
  XENP35151 Chain 2 - 1A7[CD28]_H1.14_L1_scFv(GKPGS)4-Fc(216)_IgG1 _C220S/PVA_/S267K/S364K/E357Q/M428L/N434S

SEQ ID NO: 988 - protein, 215 aa, Artificial Sequence
  Description of Artificial Sequence: Synthetic polypeptide
  XENP35151 Chain 3 - 4F12[B7H3]_L1.1
DIVMTQSPSSLSASVGDRVTITCRASQSIANELSWYQQKPGKPPKLLIYRASTLTSGVPSRFKGSGSGTDFTLTISSLQPEDFATYYCQSTYNGRAIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 989 - protein, 446 aa, Artificial Sequence
  Description of Artificial Sequence: Synthetic polypeptide
  XENP35153 Chain 1 - 38E2[B7H3]_H2_L1.1_Fab-IgG1_pI(-)_Isosteric _A_/PVA_/S267K/L368D/K370S/M428L/N434S
EVQLLESGGGLVQPGGSLRLSCAVSGFSLSSYGVIWVRQAPGKGLEYVSWVSSGGSTNYASSVKGRFTISRDTSKNTVYLQMNSLRAEDTAVYFCARGATNSGTDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 990 - protein, 479 aa, Artificial Sequence; identical to SEQ ID NO: 984
  Description of Artificial Sequence: Synthetic polypeptide
  XENP35153 Chain 2 - 1A7[CD28]_H1.14_L1_scFv(GKPGS)4-Fc(216)_IgG1 _C220S/PVA_/S267K/S364K/E357Q/M428L/N434S

SEQ ID NO: 991 - protein, 217 aa, Artificial Sequence
  Description of Artificial Sequence: Synthetic polypeptide
  XENP35153 Chain 3 - 38E2[B7H3]_L1.1
DIVMTQSPSSLSASVGDRVTITCRASQSINSWLSWYQQKPGKPPKLLIYGASNLASGVPSRFKGSGSGTDFTLTISSLQPEDFATYYCQNNYGIIAAGATFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 992 - protein, 450 aa, Artificial Sequence
  Description of Artificial Sequence: Synthetic polypeptide
  XENP34389 Chain 1 - 6A1[B7H3]_H1_Fab_IgG1_pI(-)_Isosteric_A_/ PVA_/S267K/L368D/K370S
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 993 - protein, 717 aa, Artificial Sequence
  Description of Artificial Sequence: Synthetic polypeptide
  XENP34389 Chain 2 - 6A1[B7H3]_H1_Fab_(G4S)2_1A7[CD28]_H1.14_L1_ scFv(GKPGS)4_(G4S)2_Fc(222)_IgG1_PVA_/S267K/S364K/E357Q
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 994 - protein, 213 aa, Artificial Sequence; identical to SEQ ID NO: 955
  Description of Artificial Sequence: Synthetic polypeptide
  XENP34389 Chain 3 - 6A1[B7H3]_L1 Light Chain

SEQ ID NO: 995 - protein, 450 aa, Artificial Sequence; identical to SEQ ID NO: 983
  Description of Artificial Sequence: Synthetic polypeptide
  XENP34395 Chain 1 - 6A1[B7H3]_H1_Fab-IgG1_pI(-)_Isosteric_A_/ PVA_/S267K/L368D/K370S/M428L/N434S

SEQ ID NO: 996 - protein, 717 aa, Artificial Sequence
  Description of Artificial Sequence: Synthetic polypeptide
  XENP34395 Chain 2 - 6A1[B7H3]_H1_Fab_(G4S)2_1A7[CD28]_H1.14_L1_ scFv(GKPGS)4_(G4S)2-Fc(222)_IgG1_PVA_/S267K/S364K/E357Q/M428L /N434S
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 997 - protein, 213 aa, Artificial Sequence; identical to SEQ ID NO: 955
  Description of Artificial Sequence: Synthetic polypeptide
  XENP34395 Chain 3 - 6A1[B7H3]_L1

SEQ ID NO: 998 - protein, 450 aa, Artificial Sequence; identical to SEQ ID NO: 992
  Description of Artificial Sequence: Synthetic polypeptide
  XENP34728 Chain 1 - 6A1[B7H3]_H1_Fab_IgG1_pI(-)_Isosteric_A_/ PVA_/S267K/L368D/K370S

SEQ ID NO: 999 - protein, 479 aa, Artificial Sequence; identical to SEQ ID NO: 981
  Description of Artificial Sequence: Synthetic polypeptide
  XENP34728 Chain 2 - 1A7[CD28]_H1.14_L1_scFv(GKPGS)4_Fc(216)_IgG1 _C220S/PVA_/S267K/S364K/E357Q

SEQ ID NO: 1000 - protein, 213 aa, Artificial Sequence; identical to SEQ ID NO: 955
  Description of Artificial Sequence: Synthetic polypeptide
  XENP34728 Chain 3 - 6A1[B7H3]_L1 Light Chain

SEQ ID NO: 1001 - protein, 450 aa, Artificial Sequence
  Description of Artificial Sequence: Synthetic polypeptide
  XENP34717 Chain 1 - 1A7[CD28]_H1.14_Fab_IgG1_pI(-)_Isosteric_A_ PVA_/S267K/L368D/K370S
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1002 - protein, 448 aa, Artificial Sequence
  Description of Artificial Sequence: Synthetic polypeptide
  XENP34717 Chain 2 - 2E4A3.189[B7H3]_H1.22_Fab_IgG1_PVA_/S267K /S364K/E357Q
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1003 - protein, 214 aa, Artificial Sequence; identical to SEQ ID NO: 879
  Description of Artificial Sequence: Synthetic polypeptide
  XENP34717 Chain 3 - 1A7[CD28]_L1 Light Chain

SEQ ID NO: 1004 - protein, 450 aa, Artificial Sequence; identical to SEQ ID NO: 1001
  Description of Artificial Sequence: Synthetic polypeptide
  XENP34336 Chain 1 -1A7[CD28]_H1.14_L1_Fab-IgG1_pI(-)_Isosteric _A_PVA_/S267K/L368D/K370S

SEQ ID NO: 1005 - protein, 680 aa, Artificial Sequence
  Description of Artificial Sequence: Synthetic polypeptide
  XENP34336 Chain 2 -2E4A3.189[B7H3]_H1.3_1A7[CD28]_L1_Fab_(GKPGS) 2_2E4A3.189[B7H3]_H1.3_1A7[CD28]_L1_Fab-IgG1_PVA_/S267K/S364K /E357Q
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1006 - protein, 214 aa, Artificial Sequence; identical to SEQ ID NO: 879
  Description of Artificial Sequence: Synthetic polypeptide
  XENP34336 Chain 3 -1A7[CD28]_L1

SEQ ID NO: 1007 - protein, 450 aa, Artificial Sequence; identical to SEQ ID NO: 1001
  Description of Artificial Sequence: Synthetic polypeptide
  XENP34339 Chain 1 - 1A7[CD28]_H1.14_Fab_IgG1_pI(-)_Isosteric _A_PVA_/S267K/L368D/K370S

SEQ ID NO: 1008 - protein, 680 aa, Artificial Sequence
  Description of Artificial Sequence: Synthetic polypeptide
  XENP34339 Chain 2 - 2E4A3.189[B7H3]_H1.22_Fab_(GKPGS)2_2E4A3.189 [B7H3]_H1.22_Fab_IgG1_PVA_/S267K/S364K/E357Q
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1009 - protein, 214 aa, Artificial Sequence; identical to SEQ ID NO: 879
  Description of Artificial Sequence: Synthetic polypeptide
  XENP34339 Chain 3 - 1A7[CD28]_L1 Light Chain

SEQ ID NO: 1010 - protein, 450 aa, Artificial Sequence
  Description of Artificial Sequence: Synthetic polypeptide
  XENP34398 Chain 1 -1A7[CD28]_H1.14_L1_Fab-IgG1_pI(-)_Isosteric _A_PVA_/S267K/L368D/K370S/M428L/N434S
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1011 - protein, 680 aa, Artificial Sequence
  Description of Artificial Sequence: Synthetic polypeptide
  XENP34398 Chain 2 -2E4A3.189[B7H3]_H1.22_1A7_L1_Fab_(GKPGS)2_ 2E4A3.189[B7H3]_H1.22_1A7_L1_Fab-IgG1_PVA_/S267K/S364K/E357Q /M428L/N434S
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1012 - protein, 214 aa, Artificial Sequence; identical to SEQ ID NO: 879
  Description of Artificial Sequence: Synthetic polypeptide
  XENP34398 Chain 3 -1A7[CD28]_L1

SEQ ID NO: 1013 - protein, 450 aa, Artificial Sequence
  Description of Artificial Sequence: Synthetic polypeptide
  XENP35611 Chain 1 -1A7[CD28]_H1L1_Fab-IgG1_pI(-)_Isosteric_ A_PVA_/S267K/L368D/K370S
EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1014 - protein, 680 aa, Artificial Sequence; identical to SEQ ID NO: 1008
  Description of Artificial Sequence: Synthetic polypeptide
  XENP35611 Chain 2 -2E4A3.189[B7H3]_H1.22_1A7[CD28]_L1_Fab_ (GKPGS)2_2E4A3.189[B7H3]_H1.22_1A7[CD28]_L1_Fab-IgG1_PVA_ /S267K/S364K/E357Q

SEQ ID NO: 1015 - protein, 214 aa, Artificial Sequence; identical to SEQ ID NO: 879
  Description of Artificial Sequence: Synthetic polypeptide
  XENP35611 Chain 3 -1A7[CD28]_L1

SEQ ID NO: 1016 - protein, 450 aa, Artificial Sequence
  Description of Artificial Sequence: Synthetic polypeptide
  XENP35612 Chain 1 -1A7[CD28]_H1.1_L1_Fab-IgG1_pI(-)_Isosteric _A_PVA_/S267K/L368D/K370S
EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1017 - protein, 680 aa, Artificial Sequence; identical to SEQ ID NO: 1008
  Description of Artificial Sequence: Synthetic polypeptide
  XENP35612 Chain 2 -2E4A3.189[B7H3]_H1.22_1A7[CD28]_L1_Fab_ (GKPGS)2_2E4A3.189[B7H3]_H1.22_1A7[CD28]_L1_Fab-IgG1_PVA_ /S267K/S364K/E357Q

SEQ ID NO: 1018 - protein, 214 aa, Artificial Sequence; identical to SEQ ID NO: 879
  Description of Artificial Sequence: Synthetic polypeptide
  XENP35612 Chain 3 -1A7[CD28]_L1

SEQ ID NO: 1019 - protein, 450 aa, Artificial Sequence
  Description of Artificial Sequence: Synthetic polypeptide
  XENP37808 Chain 1 -1A7[CD28]_H1.1_L1_Fab-IgG1_pI(-)_Isosteric_A _PVA_/S267K/L368D/K370S/M428L/N434S
EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1020 - protein, 680 aa, Artificial Sequence; identical to SEQ ID NO: 1011
  Description of Artificial Sequence: Synthetic polypeptide
  XENP37808 Chain 2 -2E4A3.189[B7H3]_H1.22_1A7[CD28]_L1_Fab_ (GKPGS)2_2E4A3.189[B7H3]_H1.22_1A7[CD28]_L1_Fab-IgG1_PVA_ /S267K/S364K/E357Q/M428L/N434S

SEQ ID NO: 1021 - protein, 214 aa, Artificial Sequence; identical to SEQ ID NO: 879
  Description of Artificial Sequence: Synthetic polypeptide
  XENP37808 Chain 3 -1A7[CD28]_L1

SEQ ID NO: 1022 - protein, 450 aa, Artificial Sequence; identical to SEQ ID NO: 1010
  Description of Artificial Sequence: Synthetic polypeptide
  XENP37810 Chain 1 -1A7[CD28]_H1.14_L1_Fab-IgG1_pI(-)_Isosteric_ A_PVA_/S267K/L368D/K370S/M428L/N434S

SEQ ID NO: 1023 - protein, 680 aa, Artificial Sequence
  Description of Artificial Sequence: Synthetic polypeptide
  XENP37810 Chain 2 -2E4A3.189[B7H3]_H1.3_1A7[CD28]_L1_Fab_ (GKPGS)2_2E4A3.189[B7H3]_H1.3_1A7[CD28]_L1_Fab-IgG1_PVA_ /S267K/S364K/E357Q/M428L/N434S
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1024 - protein, 214 aa, Artificial Sequence; identical to SEQ ID NO: 879
  Description of Artificial Sequence: Synthetic polypeptide
  XENP37810 Chain 3 -1A7[CD28]_L1

SEQ ID NO: 1025 - protein, 450 aa, Artificial Sequence; identical to SEQ ID NO: 983
  Description of Artificial Sequence: Synthetic polypeptide
  XENP36781 Chain 1 - 6A1[B7H3]_H1L1_Fab-IgG1_pI(-)_Isosteric_ A_/PVA_/S267K/L368D/K370S/M428L/N434S

SEQ ID NO: 1026 - protein, 712 aa, Artificial Sequence
  Description of Artificial Sequence: Synthetic polypeptide
  XENP36781 Chain 2 - 6A1[B7H3]_H1L1_Fab-IgG1_PVA_/S267K/S364K/ E357Q/M428L/N434S/K447del_(G4S)3_1A7[CD28]_H1.14_L1_scFv(GKPGS)4
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1027 - protein, 213 aa, Artificial Sequence; identical to SEQ ID NO: 955
  Description of Artificial Sequence: Synthetic polypeptide
  XENP36781 Chain 3 - 6A1[B7H3]_L1

SEQ ID NO: 1028 - protein, 448 aa, Artificial Sequence
  Description of Artificial Sequence: Synthetic polypeptide
  XENP37805 Chain 1 - 2E4A3.189[B7H3]_H1L1_Fab-IgG1_pI(-)_Isosteric _A_/PVA_/S267K/L368D/K370S/M428L/N434S
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1029 - protein, 710 aa, Artificial Sequence
  Description of Artificial Sequence: Synthetic polypeptide
  XENP37805 Chain 2 - 2E4A3.189[B7H3]_H1L1_Fab-IgG1_PVA_/S267K/ S364K/E357Q/M428L/N434S/K447del_(G4S)3_1A7[CD28]_H1.14_L1_ scFv(GKPGS)4
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1030 - protein, 214 aa, Artificial Sequence; identical to SEQ ID NO: 937
  Description of Artificial Sequence: Synthetic polypeptide
  XENP37805 Chain 3 - 2E4A3.189[B7H3]_L1

SEQ ID NO: 1031 - protein, 448 aa, Artificial Sequence
  Description of Artificial Sequence: Synthetic polypeptide
  XENP37806 Chain 1 - 2E4A3.189[B7H3]_H1.3_L1_Fab-IgG1_pI(-)_ Isosteric_A_/PVA_/S267K/L368D/K370S/M428L/N434S
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1032 - protein, 710 aa, Artificial Sequence
  Description of Artificial Sequence: Synthetic polypeptide
  XENP37806 Chain 2 - 2E4A3.189[B7H3]_H1.3_L1_Fab-IgG1_PVA_/S267K/ S364K/E357Q/M428L/N434S/K447del_(G4S)3_1A7[CD28]_H1.14_L1_ scFv(GKPGS)4
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1033 - protein, 214 aa, Artificial Sequence; identical to SEQ ID NO: 937
  Description of Artificial Sequence: Synthetic polypeptide
  XENP37806 Chain 3 - 2E4A3.189[B7H3]_L1

SEQ ID NO: 1034 - protein, 448 aa, Artificial Sequence
  Description of Artificial Sequence: Synthetic polypeptide
  XENP37807 Chain 1 - 2E4A3.189[B7H3]_H1.22_L1_Fab-IgG1_pI(-)_ Isosteric_A_/PVA_/S267K/L368D/K370S/M428L/N434S
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1035 - protein, 710 aa, Artificial Sequence
  Description of Artificial Sequence: Synthetic polypeptide
  XENP37807 Chain 2 - 2E4A3.189[B7H3]_H1.22_L1_Fab-IgG1_PVA_/S267K /S364K/E357Q/M428L/N434S/K447del_(G4S)3_1A7[CD28]_H1.14_L1_ scFv(GKPGS)4
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1036 - protein, 214 aa, Artificial Sequence; identical to SEQ ID NO: 937
  Description of Artificial Sequence: Synthetic polypeptide
  XENP37807 Chain 3 - 2E4A3.189[B7H3]_L1

SEQ ID NO: 1037 - protein, 448 aa, Artificial Sequence
  Description of Artificial Sequence: Synthetic polypeptide
  XENP37982 Chain 1 - 3C4[B7H3]_H1_L1.1_Fab-IgG1_pI(-)_Isosteric_ A_/PVA_/S267K/L368D/K370S/M428L/N434S
QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1038 - protein, 710 aa, Artificial Sequence
  Description of Artificial Sequence: Synthetic polypeptide
  XENP37982 Chain 2 - 3C4[B7H3]_H1_L1.1_Fab-IgG1_PVA_/S267K/S364K /E357Q/M428L/N434S/K447del_(G4S)3_1A7[CD28]_H1.14_L1_scFv(GKPGS)4
QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1039 - protein, 213 aa, Artificial Sequence
  Description of Artificial Sequence: Synthetic polypeptide
  XENP37982 Chain 3 - 3C4[B7H3]_L1.1
DIQMTQSPSSLSASVGDRVTITCRTSQSIYKSLAWYQQKPGKAPKLLIYNAHSLQTGIPSRFSGSGSGTDFTLTISSLQPEDFATYFCQQYYSGLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1040 - protein, 444 aa, Artificial Sequence
  Description of Artificial Sequence: Synthetic polypeptide
  XENP31602 Chain 1 - PSMA-H_H1_IgG1_pI(-)_Isosteric_A_/PVA_/ S267K/L368D/K370S
EVQLVQSGAEVKKPGASVKVSCKTSGYTFTEYTIHWVRQAPGQSLEWMGNINPNNGGTTYNQKFQGRVTITVDKSTSTAYMELSSLRSEDTAVYYCAAGWNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1041 - protein, 717 aa, Artificial Sequence
  Description of Artificial Sequence: Synthetic polypeptide
  XENP31602 Chain 2 - PSMA-H_H1_CH1_(G4S)2_[CD3]_H1.30_L1.47_ scFv(GKPGS)4_(G4S)2_Fc(222)_IgG1_PVA_/S267K/S364K/E357Q
EVQLVQSGAEVKKPGASVKVSCKTSGYTFTEYTIHWVRQAPGQSLEWMGNINPNNGGTTYNQKFQGRVTITVDKSTSTAYMELSSLRSEDTAVYYCAAGWNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1042 - protein, 214 aa, Artificial Sequence
  Description of Artificial Sequence: Synthetic polypeptide
  XENP31602 Chain 3 - PSMA-H_L1 Light Chain
DIVMTQSPDSLAVSLGERATLSCRASQDVGTAVDWYQQKPDQSPKLLIYWASTRHTGVPDRFTGSGSGTDFTLTISSLQAEDVAVYFCQQYNSYPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1043 - protein, 444 aa, Artificial Sequence; identical to SEQ ID NO: 1040
  Description of Artificial Sequence: Synthetic polypeptide
  XENP32220 Chain 1 - PSMA-H_H1_IgG1_pI(-)_Isosteric_A_/PVA_/ S267K/L368D/K370S

SEQ ID NO: 1044 - protein, 717 aa, Artificial Sequence
  Description of Artificial Sequence: Synthetic polypeptide
  XENP32220 Chain 2 - PSMA-H_H1_(G4S)_[CD3]_L1.47_H1.32_ scFv(GKPGS)4_Fc(222)_IgG1_C220S/PVA_/S267K/S364K/E357Q
EVQLVQSGAEVKKPGASVKVSCKTSGYTFTEYTIHWVRQAPGQSLEWMGNINPNNGGTTYNQKFQGRVTITVDKSTSTAYMELSSLRSEDTAVYYCAAGWNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1045 - protein, 214 aa, Artificial Sequence
  Description of Artificial Sequence: Synthetic polypeptide
  XENP32220 Chain 3 - PSMA-H_L1.24 Light Chain
DIVMTQSPDSLAVSLGERATLSCRASQDVGTAVDWYQQKPDQSPKLLIYYASTRHTGVPDRFTGSGSGTDFTLTISSLQAEDVAVYFCQQYNSYPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1046 - protein, 254 aa, Artificial Sequence
  Description of Artificial Sequence: Synthetic polypeptide
  CD3 High - [anti-CD3]_H1.30_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1047 - protein, 125 aa, Artificial Sequence
  Description of Artificial Sequence: Synthetic polypeptide
  CD3 High - [anti-CD3]_H1.30_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1048 - protein, 5 aa, Artificial Sequence
  Description of Artificial Sequence: Synthetic peptide
  CD3 High - [anti-CD3]_H1.30_L1.47_scFv vhCDR1
TYAMN

SEQ ID NO: 1049 - protein, 19 aa, Artificial Sequence
  Description of Artificial Sequence: Synthetic peptide
  CD3 High - [anti-CD3]_H1.30_L1.47_scFv vhCDR2
RIRSKYNNYATYYADSVKG

SEQ ID NO: 1050 - protein, 14 aa, Artificial Sequence
  Description of Artificial Sequence: Synthetic peptide
  CD3 High - [anti-CD3]_H1.30_L1.47_scFv vhCDR3
HGNFGDSYVSWFAY

SEQ ID NO: 1051 - protein, 109 aa, Artificial Sequence
  Description of Artificial Sequence: Synthetic polypeptide
  CD3 High - [anti-CD3]_H1.30_L1.47_scFv Variable Light (vl) Domain
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1052 - protein, 14 aa, Artificial Sequence
  Description of Artificial Sequence: Synthetic peptide
  CD3 High - [anti-CD3]_H1.30_L1.47_scFv vlCDR1
GSSTGAVTTSNYAN

SEQ ID NO: 1053 - protein, 7 aa, Artificial Sequence
  Description of Artificial Sequence: Synthetic peptide
  CD3 High - [anti-CD3]_H1.30_L1.47_scFv vlCDR2
GTNKRAP

SEQ ID NO: 1054 - protein, 9 aa, Artificial Sequence
  Description of Artificial Sequence: Synthetic peptide
  CD3 High - [anti-CD3]_H1.30_L1.47_scFv vlCDR3
ALWYSNHWV

SEQ ID NO: 1055 - protein, 20 aa, Artificial Sequence
  Description of Artificial Sequence: Synthetic peptide
  CD3 High - [anti-CD3]_H1.30_L1.47_scFv Linker
GKPGSGKPGSGKPGSGKPGS

SEQ ID NO: 1056 - protein, 254 aa, Artificial Sequence
  Description of Artificial Sequence: Synthetic polypeptide
  CD3 High-Int #1 - [anti-CD3]_H1.32_L1.47_scFv scFv
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1057 - protein, 125 aa, Artificial Sequence
  Description of Artificial Sequence: Synthetic polypeptide
  CD3 High-Int #1 - [anti-CD3]_H1.32_L1.47_scFv Variable Heavy (vh) Domain
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 1058 - protein, 5 aa, Artificial Sequence
  Description of Artificial Sequence: Synthetic peptide
  CD3 High-Int #1 - [anti-CD3]_H1.32_L1.47_scFv vhCDR1
TYAMN

SEQ ID NO: 1059 - protein, 19 aa, Artificial Sequence
  Description of Artificial Sequence: Synthetic peptide
  CD3 High-Int #1 - [anti-CD3]_H1.32_L1.47_scFv vhCDR2
RIRSKANNYATYYADSVKG

SEQ ID NO: 1060 - protein, 14 aa, Artificial Sequence
  Description of Artificial Sequence: Synthetic peptide
  CD3 High-Int #1 - [anti-CD3]_H1.32_L1.47_scFv vhCDR3
HGNFGDSYVSWFAY

SEQ ID NO: 1061 - protein, 109 aa, Artificial Sequence; identical to SEQ ID NO: 1051
  Description of Artificial Sequence: Synthetic polypeptide
  CD3 High-Int #1 - [anti-CD3]_H1.32_L1.47_scFv Variable Light (vl) Domain

SEQ ID NO: 1062 - protein, 14 aa, Artificial Sequence
  Description of Artificial Sequence: Synthetic peptide
  CD3 High-Int #1 - [anti-CD3]_H1.32_L1.47_scFv vlCDR1
GSSTGAVTTSNYAN

SEQ ID NO: 1063 - protein, 7 aa, Artificial Sequence
  Description of Artificial Sequence: Synthetic peptide
  CD3 High-Int #1 - [anti-CD3]_H1.32_L1.47_scFv vlCDR2
GTNKRAP

SEQ ID NO: 1064 - protein, 9 aa, Artificial Sequence
  Description of Artificial Sequence: Synthetic peptide
  CD3 High-Int #1 - [anti-CD3]_H1.32_L1.47_scFv vlCDR3
ALWYSNHWV

SEQ ID NO: 1065 - protein, 20 aa, Artificial Sequence
  Description of Artificial Sequence: Synthetic peptide
  CD3 High-Int #1 - [anti-CD3]_H1.32_L1.47_scFv Linker
GKPGSGKPGSGKPGSGKPGS

SEQ ID NO: 1066 - protein, 254 aa, Artificial Sequence
  Description of Artificial Sequence: Synthetic polypeptide
  CD3 High-Int #2 - [anti-CD3]_H1.89_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1067 - protein, 125 aa, Artificial Sequence
  Description of Artificial Sequence: Synthetic polypeptide
  CD3 High-Int #2 - [anti-CD3]_H1.89_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 1068 - protein, 5 aa, Artificial Sequence
  Description of Artificial Sequence: Synthetic peptide
  CD3 High-Int #2 - [anti-CD3]_H1.89_L1.47_scFv vhCDR1
TYAMN

SEQ ID NO: 1069 - protein, 19 aa, Artificial Sequence
  Description of Artificial Sequence: Synthetic peptide
  CD3 High-Int #2 - [anti-CD3]_H1.89_L1.47_scFv vhCDR2
RIRSKYNNYATYYADSVKG

SEQ ID NO: 1070 - protein, 14 aa, Artificial Sequence
  Description of Artificial Sequence: Synthetic peptide
  CD3 High-Int #2 - [anti-CD3]_H1.89_L1.47_scFv vhCDR3
HGNFGDEYVSWFAY

SEQ ID NO: 1071 - protein, 109 aa, Artificial Sequence; identical to SEQ ID NO: 1051
  Description of Artificial Sequence: Synthetic polypeptide
  CD3 High-Int #2 - [anti-CD3]_H1.89_L1.47_scFv Variable Light (vl) Domain

SEQ ID NO: 1072 - protein, 14 aa, Artificial Sequence
  Description of Artificial Sequence: Synthetic peptide
  CD3 High-Int #2 - [anti-CD3]_H1.89_L1.47_scFv vlCDR1
GSSTGAVTTSNYAN

SEQ ID NO: 1073 - protein, 7 aa, Artificial Sequence
  Description of Artificial Sequence: Synthetic peptide
  CD3 High-Int #2 - [anti-CD3]_H1.89_L1.47_scFv vlCDR2
GTNKRAP

SEQ ID NO: 1074 - protein, 9 aa, Artificial Sequence
  Description of Artificial Sequence: Synthetic peptide
  CD3 High-Int #2 - [anti-CD3]_H1.89_L1.47_scFv vlCDR3
ALWYSNHWV

SEQ ID NO: 1075 - protein, 20 aa, Artificial Sequence
  Description of Artificial Sequence: Synthetic peptide
  CD3 High-Int #2 - [anti-CD3]_H1.89_L1.47_scFv Linker
GKPGSGKPGSGKPGSGKPGS

SEQ ID NO: 1076 - protein, 254 aa, Artificial Sequence
  Description of Artificial Sequence: Synthetic polypeptide
  CD3 High-Int - [anti-CD3]_H1.90_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1077 - protein, 125 aa, Artificial Sequence
  Description of Artificial Sequence: Synthetic polypeptide
  CD3 High-Int - [anti-CD3]_H1.90_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 1078 - protein, 5 aa, Artificial Sequence
  Description of Artificial Sequence: Synthetic peptide
  CD3 High-Int - [anti-CD3]_H1.90_L1.47_scFv vhCDR1
TYAMN

SEQ ID NO: 1079 - protein, 19 aa, Artificial Sequence
  Description of Artificial Sequence: Synthetic peptide
  CD3 High-Int - [anti-CD3]_H1.90_L1.47_scFv vhCDR2
RIRSKYNNYATYYADSVKG

SEQ ID NO: 1080 - protein, 14 aa, Artificial Sequence
  Description of Artificial Sequence: Synthetic peptide
  CD3 High-Int - [anti-CD3]_H1.90_L1.47_scFv vhCDR3
HGNFGDPYVSWFAY

SEQ ID NO: 1081 - protein, 109 aa, Artificial Sequence; identical to SEQ ID NO: 1051
  Description of Artificial Sequence: Synthetic polypeptide
  CD3 High-Int - [anti-CD3]_H1.90_L1.47_scFv Variable Light (vl) Domain

SEQ ID NO: 1082 - protein, 14 aa, Artificial Sequence
  Description of Artificial Sequence: Synthetic peptide
  CD3 High-Int - [anti-CD3]_H1.90_L1.47_scFv vlCDR1
GSSTGAVTTSNYAN

SEQ ID NO: 1083 - protein, 7 aa, Artificial Sequence
  Description of Artificial Sequence: Synthetic peptide
  CD3 High-Int - [anti-CD3]_H1.90_L1.47_scFv vlCDR2
GTNKRAP

SEQ ID NO: 1084 - protein, 9 aa, Artificial Sequence
  Description of Artificial Sequence: Synthetic peptide
  CD3 High-Int - [anti-CD3]_H1.90_L1.47_scFv vlCDR3
ALWYSNHWV

SEQ ID NO: 1085 - protein, 20 aa, Artificial Sequence
  Description of Artificial Sequence: Synthetic peptide
  CD3 High-Int - [anti-CD3]_H1.90_L1.47_scFv Linker
GKPGSGKPGSGKPGSGKPGS

SEQ ID NO: 1086 - protein, 254 aa, Artificial Sequence
  Description of Artificial Sequence: Synthetic polypeptide
  Anti-CD3-Intermediate - [anti-CD3]_H1.33_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1087 - protein, 125 aa, Artificial Sequence
  Description of Artificial Sequence: Synthetic polypeptide
  Anti-CD3-Intermediate - [anti-CD3]_H1.33_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 1088 - protein, 5 aa, Artificial Sequence
  Description of Artificial Sequence: Synthetic peptide
  Anti-CD3-Intermediate - [anti-CD3]_H1.33_L1.47_scFv vhCDR1
TYAMN

SEQ ID NO: 1089 - protein, 19 aa, Artificial Sequence
  Description of Artificial Sequence: Synthetic peptide
  Anti-CD3-Intermediate - [anti-CD3]_H1.33_L1.47_scFv vhCDR2
RIRSKYNNYATYYADSVKG

SEQ ID NO: 1090 - protein, 14 aa, Artificial Sequence
  Description of Artificial Sequence: Synthetic peptide
  Anti-CD3-Intermediate - [anti-CD3]_H1.33_L1.47_scFv vhCDR3
HGNFGDSYVSWFDY

SEQ ID NO: 1091 - protein, 109 aa, Artificial Sequence; identical to SEQ ID NO: 1051
  Description of Artificial Sequence: Synthetic polypeptide
  Anti-CD3-Intermediate - [anti-CD3]_H1.33_L1.47_scFv Variable Light (vl) Domain

SEQ ID NO: 1092 - protein, 14 aa, Artificial Sequence
  Description of Artificial Sequence: Synthetic peptide
  Anti-CD3-Intermediate - [anti-CD3]_H1.33_L1.47_scFv vlCDR1
GSSTGAVTTSNYAN

SEQ ID NO: 1093 - protein, 7 aa, Artificial Sequence
  Description of Artificial Sequence: Synthetic peptide
  Anti-CD3-Intermediate - [anti-CD3]_H1.33_L1.47_scFv vlCDR2
GTNKRAP

SEQ ID NO: 1094 - protein, 9 aa, Artificial Sequence
  Description of Artificial Sequence: Synthetic peptide
  Anti-CD3-Intermediate - [anti-CD3]_H1.33_L1.47_scFv vlCDR3
ALWYSNHWV

SEQ ID NO: 1095 - protein, 20 aa, Artificial Sequence
  Description of Artificial Sequence: Synthetic peptide
  Anti-CD3-Intermediate - [anti-CD3]_H1.33_L1.47_scFv Linker
GKPGSGKPGSGKPGSGKPGS

SEQ ID NO: 1096 - protein, 254 aa, Artificial Sequence
  Description of Artificial Sequence: Synthetic polypeptide
  CD3 High-Int - [anti-CD3]_H1.31_L1.47_scFv scFv
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1097 - protein, 125 aa, Artificial Sequence
  Description of Artificial Sequence: Synthetic polypeptide
  CD3 High-Int - [anti-CD3]_H1.31_L1.47_scFv Variable Heavy (vh) Domain
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1098 - protein, 5 aa, Artificial Sequence
  Description of Artificial Sequence: Synthetic peptide
  CD3 High-Int - [anti-CD3]_H1.31_L1.47_scFv vhCDR1
TYAMS

SEQ ID NO: 1099 - protein, 19 aa, Artificial Sequence
  Description of Artificial Sequence: Synthetic peptide
  CD3 High-Int - [anti-CD3]_H1.31_L1.47_scFv vhCDR2
RIRSKYNNYATYYADSVKG

SEQ ID NO: 1100 - protein, 14 aa, Artificial Sequence
  Description of Artificial Sequence: Synthetic peptide
  CD3 High-Int - [anti-CD3]_H1.31_L1.47_scFv vhCDR3
HGNFGDSYVSWFAY

SEQ ID NO: 1101 - protein, 109 aa, Artificial Sequence; identical to SEQ ID NO: 1051
  Description of Artificial Sequence: Synthetic polypeptide
  CD3 High-Int - [anti-CD3]_H1.31_L1.47_scFv Variable Light (vl) Domain

SEQ ID NO: 1102 - protein, 14 aa, Artificial Sequence
  Description of Artificial Sequence: Synthetic peptide
  CD3 High-Int - [anti-CD3]_H1.31_L1.47_scFv vlCDR1
GSSTGAVTTSNYAN

SEQ ID NO: 1103 - protein, 7 aa, Artificial Sequence
  Description of Artificial Sequence: Synthetic peptide
  CD3 High-Int - [anti-CD3]_H1.31_L1.47_scFv vlCDR2
GTNKRAP

SEQ ID NO: 1104 - protein, 9 aa, Artificial Sequence
  Description of Artificial Sequence: Synthetic peptide
  CD3 High-Int - [anti-CD3]_H1.31_L1.47_scFv vlCDR3
ALWYSNHWV

SEQ ID NO: 1105 - protein, 20 aa, Artificial Sequence
  Description of Artificial Sequence: Synthetic peptide
  CD3 High-Int - [anti-CD3]_H1.31_L1.47_scFv Linker
GKPGSGKPGSGKPGSGKPGS

SEQ ID NO: 1106 - protein, 254 aa, Artificial Sequence
  Description of Artificial Sequence: Synthetic polypeptide
  CD3 High[VL-VH] - [anti-CD3]_L1.47_ H1.30_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1107 - protein, 109 aa, Artificial Sequence; identical to SEQ ID NO: 1051
  Description of Artificial Sequence: Synthetic polypeptide
  CD3 High[VL-VH] - [anti-CD3]_L1.47_ H1.30_scFv Variable Light (vl) Domain

SEQ ID NO: 1108 - protein, 14 aa, Artificial Sequence
  Description of Artificial Sequence: Synthetic peptide
  CD3 High[VL-VH] - [anti-CD3]_L1.47_ H1.30_scFv vlCDR1
GSSTGAVTTSNYAN

SEQ ID NO: 1109 - protein, 7 aa, Artificial Sequence
  Description of Artificial Sequence: Synthetic peptide
  CD3 High[VL-VH] - [anti-CD3]_L1.47_ H1.30_scFv vlCDR2
GTNKRAP

SEQ ID NO: 1110 - protein, 9 aa, Artificial Sequence
  Description of Artificial Sequence: Synthetic peptide
  CD3 High[VL-VH] - [anti-CD3]_L1.47_ H1.30_scFv vlCDR3
ALWYSNHWV

SEQ ID NO: 1111 - protein, 125 aa, Artificial Sequence; identical to SEQ ID NO: 1047
  Description of Artificial Sequence: Synthetic polypeptide
  CD3 High[VL-VH] - [anti-CD3]_L1.47_ H1.30_scFv Variable Heavy (vh) Domain

SEQ ID NO: 1112 - protein, 5 aa, Artificial Sequence
  Description of Artificial Sequence: Synthetic peptide
  CD3 High[VL-VH] - [anti-CD3]_L1.47_ H1.30_scFv vhCDR1
TYAMN

SEQ ID NO: 1113 - protein, 19 aa, Artificial Sequence
  Description of Artificial Sequence: Synthetic peptide
  CD3 High[VL-VH] - [anti-CD3]_L1.47_ H1.30_scFv vhCDR2
RIRSKYNNYATYYADSVKG

SEQ ID NO: 1114 - protein, 14 aa, Artificial Sequence
  Description of Artificial Sequence: Synthetic peptide
  CD3 High[VL-VH] - [anti-CD3]_L1.47_ H1.30_scFv vhCDR3
HGNFGDSYVSWFAY

SEQ ID NO: 1115 - protein, 20 aa, Artificial Sequence
  Description of Artificial Sequence: Synthetic peptide
  CD3 High[VL-VH] - [anti-CD3]_L1.47_ H1.30_scFv Linker
GKPGSGKPGSGKPGSGKPGS

SEQ ID NO: 1116 - protein, 254 aa, Artificial Sequence
  Description of Artificial Sequence: Synthetic polypeptide
  CD3 High-Int #1[VL-VH] - [anti-CD3]_L1.47_ H1.32_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 1117 - protein, 109 aa, Artificial Sequence; identical to SEQ ID NO: 1051
  Description of Artificial Sequence: Synthetic polypeptide
  CD3 High-Int #1[VL-VH] - [anti-CD3]_L1.47_ H1.32_scFv Variable Light (vl) Domain

SEQ ID NO: 1118 - protein, 14 aa, Artificial Sequence
  Description of Artificial Sequence: Synthetic peptide
  CD3 High-Int #1[VL-VH] - [anti-CD3]_L1.47_ H1.32_scFv vlCDR1
GSSTGAVTTSNYAN

SEQ ID NO: 1119 - protein, 7 aa, Artificial Sequence
  Description of Artificial Sequence: Synthetic peptide
  CD3 High-Int #1[VL-VH] - [anti-CD3]_L1.47_ H1.32_scFv vlCDR2
GTNKRAP

SEQ ID NO: 1120 - protein, 9 aa, Artificial Sequence
  Description of Artificial Sequence: Synthetic peptide
  CD3 High-Int #1[VL-VH] - [anti-CD3]_L1.47_ H1.32_scFv vlCDR3
ALWYSNHWV

SEQ ID NO: 1121 - protein, 125 aa, Artificial Sequence; identical to SEQ ID NO: 1057
  Description of Artificial Sequence: Synthetic polypeptide
  CD3 High-Int #1[VL-VH] - [anti-CD3]_L1.47_ H1.32_scFv Variable Heavy (vh) Domain

SEQ ID NO: 1122 - protein, 5 aa, Artificial Sequence
  Description of Artificial Sequence: Synthetic peptide
  CD3 High-Int #1[VL-VH] - [anti-CD3]_L1.47_ H1.32_scFv vhCDR1
TYAMN

SEQ ID NO: 1123 - protein, 19 aa, Artificial Sequence
  Description of Artificial Sequence: Synthetic peptide
  CD3 High-Int #1[VL-VH] - [anti-CD3]_L1.47_ H1.32_scFv vhCDR2
RIRSKANNYATYYADSVKG

SEQ ID NO: 1124 - protein, 14 aa, Artificial Sequence
  Description of Artificial Sequence: Synthetic peptide
  CD3 High-Int #1[VL-VH] - [anti-CD3]_L1.47_ H1.32_scFv vhCDR3
HGNFGDSYVSWFAY

SEQ ID NO: 1125 - protein, 20 aa, Artificial Sequence
  Description of Artificial Sequence: Synthetic peptide
  CD3 High-Int #1[VL-VH] - [anti-CD3]_L1.47_ H1.32_scFv Linker
GKPGSGKPGSGKPGSGKPGS

SEQ ID NO: 1126 - protein, 254 aa, Artificial Sequence
  Description of Artificial Sequence: Synthetic polypeptide
  CD3 High-Int #2[VL-VH] - [anti-CD3]_L1.47_ H1.89_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 1127 - protein, 109 aa, Artificial Sequence; identical to SEQ ID NO: 1051
  Description of Artificial Sequence: Synthetic polypeptide
  CD3 High-Int #2[VL-VH] - [anti-CD3]_L1.47_ H1.89_scFv Variable Light (vl) Domain

SEQ ID NO: 1128 - protein, 14 aa, Artificial Sequence
  Description of Artificial Sequence: Synthetic peptide
  CD3 High-Int #2[VL-VH] - [anti-CD3]_L1.47_ H1.89_scFv vlCDR1
GSSTGAVTTSNYAN

SEQ ID NO: 1129 - protein, 7 aa, Artificial Sequence
  Description of Artificial Sequence: Synthetic peptide
  CD3 High-Int #2[VL-VH] - [anti-CD3]_L1.47_ H1.89_scFv vlCDR2
GTNKRAP

SEQ ID NO: 1130 - protein, 9 aa, Artificial Sequence
  Description of Artificial Sequence: Synthetic peptide
  CD3 High-Int #2[VL-VH] - [anti-CD3]_L1.47_ H1.89_scFv vlCDR3
ALWYSNHWV

SEQ ID NO: 1131 - protein, 125 aa, Artificial Sequence; identical to SEQ ID NO: 1067
  Description of Artificial Sequence: Synthetic polypeptide
  CD3 High-Int #2[VL-VH] - [anti-CD3]_L1.47_ H1.89_scFv Variable Heavy (vh) Domain

SEQ ID NO: 1132 - protein, 5 aa, Artificial Sequence
  Description of Artificial Sequence: Synthetic peptide
  CD3 High-Int #2[VL-VH] - [anti-CD3]_L1.47_ H1.89_scFv vhCDR1
TYAMN

SEQ ID NO: 1133 - protein, 19 aa, Artificial Sequence
  Description of Artificial Sequence: Synthetic peptide
  CD3 High-Int #2[VL-VH] - [anti-CD3]_L1.47_ H1.89_scFv vhCDR2
RIRSKYNNYATYYADSVKG

SEQ ID NO: 1134 - protein, 14 aa, Artificial Sequence
  Description of Artificial Sequence: Synthetic peptide
  CD3 High-Int #2[VL-VH] - [anti-CD3]_L1.47_ H1.89_scFv vhCDR3
HGNFGDEYVSWFAY

SEQ ID NO: 1135 - protein, 20 aa, Artificial Sequence
  Description of Artificial Sequence: Synthetic peptide
  CD3 High-Int #2[VL-VH] - [anti-CD3]_L1.47_ H1.89_scFv Linker
GKPGSGKPGSGKPGSGKPGS

SEQ ID NO: 1136 - protein, 254 aa, Artificial Sequence
  Description of Artificial Sequence: Synthetic polypeptide
  CD3 High-Int[VL-VH] - [anti-CD3]_L1.47_ H1.90_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 1137 - protein, 109 aa, Artificial Sequence; identical to SEQ ID NO: 1051
  Description of Artificial Sequence: Synthetic polypeptide
  CD3 High-Int[VL-VH] - [anti-CD3]_L1.47_ H1.90_scFv Variable Light (vl) Domain

SEQ ID NO: 1138 - protein, 14 aa, Artificial Sequence
  Description of Artificial Sequence: Synthetic peptide
  CD3 High-Int[VL-VH] - [anti-CD3]_L1.47_ H1.90_scFv vlCDR1
GSSTGAVTTSNYAN

SEQ ID NO: 1139 - protein, 7 aa, Artificial Sequence
  Description of Artificial Sequence: Synthetic peptide
  CD3 High-Int[VL-VH] - [anti-CD3]_L1.47_ H1.90_scFv vlCDR2
GTNKRAP

SEQ ID NO: 1140 - protein, 9 aa, Artificial Sequence
  Description of Artificial Sequence: Synthetic peptide
  CD3 High-Int[VL-VH] - [anti-CD3]_L1.47_ H1.90_scFv vlCDR3
ALWYSNHWV

SEQ ID NO: 1141 - protein, 125 aa, Artificial Sequence; identical to SEQ ID NO: 1077
  Description of Artificial Sequence: Synthetic polypeptide
  CD3 High-Int[VL-VH] - [anti-CD3]_L1.47_ H1.90_scFv Variable Heavy (vh) Domain

SEQ ID NO: 1142 - protein, 5 aa, Artificial Sequence
  Description of Artificial Sequence: Synthetic peptide
  CD3 High-Int[VL-VH] - [anti-CD3]_L1.47_ H1.90_scFv vhCDR1
TYAMN

SEQ ID NO: 1143 - protein, 19 aa, Artificial Sequence
  Description of Artificial Sequence: Synthetic peptide
  CD3 High-Int[VL-VH] - [anti-CD3]_L1.47_ H1.90_scFv vhCDR2
RIRSKYNNYATYYADSVKG

SEQ ID NO: 1144 - protein, 14 aa, Artificial Sequence
  Description of Artificial Sequence: Synthetic peptide
  CD3 High-Int[VL-VH] - [anti-CD3]_L1.47_ H1.90_scFv vhCDR3
HGNFGDPYVSWFAY

SEQ ID NO: 1145 - protein, 20 aa, Artificial Sequence
  Description of Artificial Sequence: Synthetic peptide
  CD3 High-Int[VL-VH] - [anti-CD3]_L1.47_ H1.90_scFv Linker
GKPGSGKPGSGKPGSGKPGS

SEQ ID NO: 1146 - protein, 254 aa, Artificial Sequence
  Description of Artificial Sequence: Synthetic polypeptide
  Anti-CD3-Intermediate[VL-VH] - [anti-CD3]_L1.47_ H1.33_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 1147 - protein, 109 aa, Artificial Sequence; identical to SEQ ID NO: 1051
  Description of Artificial Sequence: Synthetic polypeptide
  Anti-CD3-Intermediate[VL-VH] - [anti-CD3]_L1.47_ H1.33_scFv Variable Light (vl) Domain

SEQ ID NO: 1148 - protein, 14 aa, Artificial Sequence
  Description of Artificial Sequence: Synthetic peptide
  Anti-CD3-Intermediate[VL-VH] - [anti-CD3]_L1.47_ H1.33_scFv vlCDR1
GSSTGAVTTSNYAN

SEQ ID NO: 1149 - protein, 7 aa, Artificial Sequence
  Description of Artificial Sequence: Synthetic peptide
  Anti-CD3-Intermediate[VL-VH] - [anti-CD3]_L1.47_ H1.33_scFv vlCDR2
GTNKRAP

SEQ ID NO: 1150 - protein, 9 aa, Artificial Sequence
  Description of Artificial Sequence: Synthetic peptide
  Anti-CD3-Intermediate[VL-VH] - [anti-CD3]_L1.47_ H1.33_scFv vlCDR3
ALWYSNHWV

SEQ ID NO: 1151 - protein, 125 aa, Artificial Sequence; identical to SEQ ID NO: 1087
  Description of Artificial Sequence: Synthetic polypeptide
  Anti-CD3-Intermediate[VL-VH] - [anti-CD3]_L1.47_ H1.33_scFv Variable Heavy (vh) Domain

SEQ ID NO: 1152 - protein, 5 aa, Artificial Sequence
  Description of Artificial Sequence: Synthetic peptide
  Anti-CD3-Intermediate[VL-VH] - [anti-CD3]_L1.47_ H1.33_scFv vhCDR1
TYAMN

SEQ ID NO: 1153 - protein, 19 aa, Artificial Sequence
  Description of Artificial Sequence: Synthetic peptide
  Anti-CD3-Intermediate[VL-VH] - [anti-CD3]_L1.47_ H1.33_scFv vhCDR2
RIRSKYNNYATYYADSVKG

SEQ ID NO: 1154 - protein, 14 aa, Artificial Sequence
  Description of Artificial Sequence: Synthetic peptide
  Anti-CD3-Intermediate[VL-VH] - [anti-CD3]_L1.47_ H1.33_scFv vhCDR3
HGNFGDSYVSWFDY

SEQ ID NO: 1155 - protein, 20 aa, Artificial Sequence
  Description of Artificial Sequence: Synthetic peptide
  Anti-CD3-Intermediate[VL-VH] - [anti-CD3]_L1.47_ H1.33_scFv Linker
GKPGSGKPGSGKPGSGKPGS

SEQ ID NO: 1156 - protein, 254 aa, Artificial Sequence
  Description of Artificial Sequence: Synthetic polypeptide
  CD3 High-Int[VL-VH] - [anti-CD3]_L1.47_ H1.31_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1157 - protein, 109 aa, Artificial Sequence; identical to SEQ ID NO: 1051
  Description of Artificial Sequence: Synthetic polypeptide
  CD3 High-Int[VL-VH] - [anti-CD3]_L1.47_ H1.31_scFv Variable Light (vl) Domain

SEQ ID NO: 1158 - protein, 14 aa, Artificial Sequence
  Description of Artificial Sequence: Synthetic peptide
  CD3 High-Int[VL-VH] - [anti-CD3]_L1.47_ H1.31_scFv vlCDR1
GSSTGAVTTSNYAN

SEQ ID NO: 1159 - protein, 7 aa, Artificial Sequence
  Description of Artificial Sequence: Synthetic peptide
  CD3 High-Int[VL-VH] - [anti-CD3]_L1.47_ H1.31_scFv vlCDR2
GTNKRAP

SEQ ID NO: 1160 - protein, 9 aa, Artificial Sequence
  Description of Artificial Sequence: Synthetic peptide
  CD3 High-Int[VL-VH] - [anti-CD3]_L1.47_ H1.31_scFv vlCDR3
ALWYSNHWV

SEQ ID NO: 1161 - protein, 125 aa, Artificial Sequence; identical to SEQ ID NO: 1097
  Description of Artificial Sequence: Synthetic polypeptide
  CD3 High-Int[VL-VH] - [anti-CD3]_L1.47_ H1.31_scFv Variable Heavy (vh) Domain

SEQ ID NO: 1162 - protein, 5 aa, Artificial Sequence
  Description of Artificial Sequence: Synthetic peptide
  CD3 High-Int[VL-VH] - [anti-CD3]_L1.47_ H1.31_scFv vhCDR1
TYAMS

SEQ ID NO: 1163 - protein, 19 aa, Artificial Sequence
  Description of Artificial Sequence: Synthetic peptide
  CD3 High-Int[VL-VH] - [anti-CD3]_L1.47_ H1.31_scFv vhCDR2
RIRSKYNNYATYYADSVKG

SEQ ID NO: 1164 - protein, 14 aa, Artificial Sequence
  Description of Artificial Sequence: Synthetic peptide
  CD3 High-Int[VL-VH] - [anti-CD3]_L1.47_ H1.31_scFv vhCDR3
HGNFGDSYVSWFAY

SEQ ID NO: 1165 - protein, 20 aa, Artificial Sequence
  Description of Artificial Sequence: Synthetic peptide
  CD3 High-Int[VL-VH] - [anti-CD3]_L1.47_ H1.31_scFv Linker
GKPGSGKPGSGKPGSGKPGS

SEQ ID NO: 1166 - protein, 447 aa, Artificial Sequence
  Description of Artificial Sequence: Synthetic polypeptide
  XENP29154_TGN1412_hu5.11A1[CD28]_H1L1_IgG4_K447del Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1167 - protein, 214 aa, Artificial Sequence
  Description of Artificial Sequence: Synthetic polypeptide
  XENP29154_TGN1412_hu5.11A1[CD28]_ L1 Light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1168 - protein, 30 aa, Artificial Sequence
  Description of Artificial Sequence: Synthetic polypeptide
  2E4A3.189 VH HFR1
  MOD_RES (27)..(27): Y or L
  MOD_RES (28)..(28): I, T, P, A, S, G, L, or F
  MOD_RES (30)..(30): T, I, V, K, E, or S
QVQLVQSGAEVKKPGASVKVSCKASGXXFX

SEQ ID NO: 1169 - protein, 5 aa, Artificial Sequence
  Description of Artificial Sequence: Synthetic peptide
  2E4A3.189 VH HCDR1
  MOD_RES (1)..(1): N, D, Q, E, I, or F
  MOD_RES (2)..(2): Y, N, H, F, or V
XXYMH

SEQ ID NO: 1170 - protein, 14 aa, Artificial Sequence
  Description of Artificial Sequence: Synthetic peptide
  2E4A3.189 VH HFR2
WVRQAPGQGLEWMG

SEQ ID NO: 1171 - protein, 17 aa, Artificial Sequence
  Description of Artificial Sequence: Synthetic peptide
  2E4A3.189 VH HCDR2
  MOD_RES (2)..(2): I or L
  MOD_RES (3)..(3): S, A, F, or G
  MOD_RES (5)..(5): S, I, V, L, Q, A, or G
  MOD_RES (6)..(6): A, S, V, G, or T
  MOD_RES (8)..(8): T, R, or S
  MOD_RES (9)..(9): T, W, or I
  MOD_RES (10)..(10): S, D, A, N, I, L, or Q
IXXPXXGXXXYAQKFQG

SEQ ID NO: 1172 - protein, 32 aa, Artificial Sequence
  Description of Artificial Sequence: Synthetic polypeptide
  2E4A3.189 VH HFR3
  MOD_RES (2)..(2): V or F
RXTMTRDTSTSTVYMELSSLRSEDTAVYYCAR

SEQ ID NO: 1173 - protein, 10 aa, Artificial Sequence
  Description of Artificial Sequence: Synthetic peptide
  2E4A3.189 VH HCDR3
  MOD_RES (1)..(1): G or A
  MOD_RES (3)..(3): G, F, W, L, or M
  MOD_RES (8)..(8): L, S, V, G, or Q
XGXSSPRXDY

SEQ ID NO: 1174 - protein, 11 aa, Artificial Sequence
  Description of Artificial Sequence: Synthetic peptide
  2E4A3.189 VH HFR4
WGQGTLVTVSS

SEQ ID NO: 1175 - protein, 23 aa, Artificial Sequence
  Description of Artificial Sequence: Synthetic peptide
  2E4A3.189 VL LFR1
DIQMTQSPSSLSASVGDRVTITC

SEQ ID NO: 1176 - protein, 11 aa, Artificial Sequence
  Description of Artificial Sequence: Synthetic peptide
  2E4A3.189 VL LCDR1
RASQSISSYLN

SEQ ID NO: 1177 - protein, 15 aa, Artificial Sequence
  Description of Artificial Sequence: Synthetic peptide
  2E4A3.189 VL LFR2
WYQQKPGKAPKLLIY

SEQ ID NO: 1178 - protein, 7 aa, Artificial Sequence
  Description of Artificial Sequence: Synthetic peptide
  2E4A3.189 VL LCDR2
AASSLQS

SEQ ID NO: 1179 - protein, 32 aa, Artificial Sequence
  Description of Artificial Sequence: Synthetic polypeptide
  2E4A3.189 VL LFR3
GVPSRFSGSGSGTDFTLTISSLQPEDFATYYC

SEQ ID NO: 1180 - protein, 9 aa, Artificial Sequence
  Description of Artificial Sequence: Synthetic peptide
  2E4A3.189 VL LCDR3
QQSYSTPYT

SEQ ID NO: 1181 - protein, 10 aa, Artificial Sequence
  Description of Artificial Sequence: Synthetic peptide
  2E4A3.189 VL LFR4
FGQGTKLEIK

SEQ ID NO: 1182 - protein, 15 aa, Artificial Sequence
  Description of Artificial Sequence: Synthetic peptide
EPKSCGKPGSGKPGS

SEQ ID NO: 1183 - protein, 10 aa, Artificial Sequence
  Description of Artificial Sequence: Synthetic peptide
EPKSCGKPGS

SEQ ID NO: 1184 - protein, 30 aa, Artificial Sequence
  Description of Artificial Sequence: Synthetic polypeptide
  1A7 VH HFR1
  MOD_RES (28)..(28): T, S, or N
  MOD_RES (29)..(29): F, or L
  MOD_RES (30)..(30): S, E, R, K, G, T, A, or N
EVQLLESGGGLVQPGGSLRLSCAASGFXXX

SEQ ID NO: 1185 - protein, 5 aa, Artificial Sequence
  Description of Artificial Sequence: Synthetic peptide
  1A7 VH HCDR1
  MOD_RES (1)..(1): S, G, E, T, D, A, R, or K
  MOD_RES (2)..(2): Y or N
  MOD_RES (3)..(3): A, Y, or S
  MOD_RES (4)..(4): M or I
  MOD_RES (5)..(5): S, T, or N
XXXXX

SEQ ID NO: 1186 - protein, 14 aa, Artificial Sequence
  Description of Artificial Sequence: Synthetic peptide
  1A7 VH HFR2
  MOD_RES (14)..(14): S or A
WVRQAPGKGLEWVX

SEQ ID NO: 1187 - protein, 17 aa, Artificial Sequence
  Description of Artificial Sequence: Synthetic peptide
  1A7 VH HCDR2
  MOD_RES (1)..(1): T or S
  MOD_RES (3)..(3): S, D, E, Y, or T
  MOD_RES (4)..(4): G, D, E, A, Y, S, N, or T
  MOD_RES (5)..(5): S, D, N, or G
  MOD_RES (6)..(6): D, T, Y, S, or A
  MOD_RES (7)..(7): D, T, Y, S, or A
  MOD_RES (8)..(8): S, Y, A, T, D, or N
XIXXXXXXTYYADSVKG

SEQ ID NO: 1188 - protein, 32 aa, Artificial Sequence
  Description of Artificial Sequence: Synthetic polypeptide
  1A7 VH HFR3
RFTISRDNSKNTLYLQMNSLRAEDTAVYYCAK

SEQ ID NO: 1189 - protein, 12 aa, Artificial Sequence
  Description of Artificial Sequence: Synthetic peptide
  1A7 VH HCDR3
SGPGLRQVGFDY

SEQ ID NO: 1190 - protein, 11 aa, Artificial Sequence
  Description of Artificial Sequence: Synthetic peptide
  1A7 VH HFR4
WGQGTLVTVSS

SEQ ID NO: 1191 - protein, 23 aa, Artificial Sequence
  Description of Artificial Sequence: Synthetic peptide
  1A7 VL LFR1
DIQMTQSPSSLSASVGDRVTITC

SEQ ID NO: 1192 - protein, 11 aa, Artificial Sequence
  Description of Artificial Sequence: Synthetic peptide
  1A7 VL LCDR1
  MOD_RES (8)..(8): S, A, D, G, H, K, N, Q, T, V, or Y
  MOD_RES (9)..(9): Y, A, D, F, H, K, L, N, Q, S, or W
  MOD_RES (11)..(11): N, A, D, G, H, Q, S, T, or Y
RASQSISXXLX

SEQ ID NO: 1193 - protein, 15 aa, Artificial Sequence
  Description of Artificial Sequence: Synthetic peptide
  1A7 VL LFR2
WYQQKPGKAPKLLIY

SEQ ID NO: 1194 - protein, 7 aa, Artificial Sequence
  Description of Artificial Sequence: Synthetic peptide
  1A7 VL LCDR2
  MOD_RES (1)..(1): A, D, G, K, L, Q, S, T, W, or Y
  MOD_RES (4)..(4): S, A, D, K, N, Q, T, or Y
  MOD_RES (6)..(6): Q, A, E, F, H, I, K, N, S, V, or Y
  MOD_RES (7)..(7): Q, A, E, F, H, I, K, N, S, V, or Y
XASXLXX

SEQ ID NO: 1195 - protein, 32 aa, Artificial Sequence; identical to SEQ ID NO: 1179
  Description of Artificial Sequence: Synthetic polypeptide
  1A7 VL LFR3

SEQ ID NO: 1196 - protein, 9 aa, Artificial Sequence
  Description of Artificial Sequence: Synthetic peptide
  1A7 VL LCDR3
  MOD_RES (3)..(3): S, A, D, F, H, K, L, T, V, or Y
  MOD_RES (4)..(4): Y, A, D, F, H, K, L, Q, V, or W
  MOD_RES (5)..(5): S, A, D, G, H, K, N, Q, T, V, or Y
  MOD_RES (6)..(6): T, A, D, F, I, K, L, Q, S, V, or Y
  MOD_RES (8)..(8): F, I, L, or W
QQXXXXPXT

SEQ ID NO: 1197 - protein, 10 aa, Artificial Sequence
  Description of Artificial Sequence: Synthetic peptide
  1A7 VL LFR4
FGQGTKLEIK

SEQ ID NO: 1198 - protein, 121 aa, Artificial Sequence
  Description of Artificial Sequence: Synthetic polypeptide
  1A7[CD28]_H1.41
EVQLLESGGGLVQPGGSLRLSCAASGFTFSSYYMSWVRQAPGKGLEWVSTIEGSGDYTYYADSVKGRFTISRDNSKNTLYLQMNSLRAEDTAVYYCAKSGPGLRQVGFDYWGQGTLVTVSS

SEQ ID NO: 1199 - protein, 121 aa, Artificial Sequence
  Description of Artificial Sequence: Synthetic polypeptide
  1A7[CD28]_H1.42
EVQLLESGGGLVQPGGSLRLSCAASGFTFSSYYMSWVRQAPGKGLEWVSTISESGDYTYYADSVKGRFTISRDNSKNTLYLQMNSLRAEDTAVYYCAKSGPGLRQVGFDYWGQGTLVTVSS

SEQ ID NO: 1200 - protein, 107 aa, Artificial Sequence
  Description of Artificial Sequence: Synthetic polypeptide
  1A7[CD28]_L1.105
DIQMTQSPSSLSASVGDRVTITCRASQSISSYLTWYQQKPGKAPKLLIYAASSLQSGVPSRFSGSGSGTDFTLTISSLQPEDFATYYCQQVYSTPFTFGQGTKLEIK

What is claimed:

1. A heterodimeric antibody that binds to human CD28 and human B7H3 comprising:
   a) a first monomer comprising the amino acid sequence of SEQ ID NO:1019;
   b) a second monomer comprising the amino acid sequence of SEQ ID NO:1020; and
   c) a light chain comprising the amino acid sequence of SEQ ID NO:1021.

2. A nucleic acid composition comprising:
   a) a first nucleic acid encoding the amino acid sequence of SEQ ID NO:1019;
   b) a second nucleic acid encoding the amino acid sequence of SEQ ID NO:1020; and
   c) a third nucleic acid encoding the amino acid sequence of SEQ ID NO:1021.

3. An expression vector composition comprising:
   a) a first expression vector comprising a first nucleic acid encoding the amino acid sequence of SEQ ID NO:1019;
   b) a second expression vector comprising a second nucleic acid encoding the amino acid sequence of SEQ ID NO:1020; and
   c) a third expression vector comprising a third nucleic acid encoding the amino acid sequence of SEQ ID NO:1021.

4. A host cell comprising the expression vector composition of claim 3.

5. A method of making a heterodimeric antibody that binds to human CD28 and human B7H3 comprising culturing the host cell of claim 4 under conditions whereby said heterodimeric antibody is expressed and recovering said heterodimeric antibody.

* * * * *